US012571006B2

(12) United States Patent (10) Patent No.: US 12,571,006 B2
Kershner et al. (45) Date of Patent: Mar. 10, 2026

(54) CONSTRUCTS AND USES THEREOF FOR EFFICIENT AND SPECIFIC GENOME EDITING

(71) Applicant: Celyntra Therapeutics SA, Mont-Saint-Guibert (BE)

(72) Inventors: Jamie Kershner, Louisville, CO (US); Rongming Liu, Boulder, CO (US); Liya Liang, Boulder, CO (US); Roland Baumgartner, Angern an der March (AT); Tanya Warnecke, Boulder, CO (US)

(73) Assignee: Celyntra Therapeutics SA, Mont-Saint-Guibert (BE)

( * ) Notice: Subject to any disclaimer, the term of this patent is extended or adjusted under 35 U.S.C. 154(b) by 0 days.

(21) Appl. No.: 18/027,054

(22) PCT Filed: Sep. 20, 2021

(86) PCT No.: PCT/US2021/051142
§ 371 (c)(1),
(2) Date: Mar. 17, 2023

(87) PCT Pub. No.: WO2022/061247
PCT Pub. Date: Mar. 24, 2022

(65) Prior Publication Data
US 2023/0323405 A1 Oct. 12, 2023

Related U.S. Application Data

(60) Provisional application No. 63/185,315, filed on May 6, 2021, provisional application No. 63/080,552, filed on Sep. 18, 2020.

(51) Int. Cl.
*C12N 15/90* (2006.01)
*C12N 9/22* (2006.01)
*C12N 15/11* (2006.01)
*C12N 15/70* (2006.01)

(52) U.S. Cl.
CPC ............. *C12N 15/907* (2013.01); *C12N 9/22* (2013.01); *C12N 15/11* (2013.01); *C12N 15/70* (2013.01); *C12N 2310/20* (2017.05); *C12N 2800/80* (2013.01)

(58) Field of Classification Search
CPC ........ C12N 15/907; C12N 9/22; C12N 15/11; C12N 15/70; C12N 2310/20; C12N 2800/80; C07K 2319/09
See application file for complete search history.

(56) References Cited

U.S. PATENT DOCUMENTS

| | | | |
|---|---|---|---|
| 2020/0149021 A1* | 5/2020 | Li | C12N 9/22 |
| 2021/0139889 A1* | 5/2021 | Chen | G01N 33/5088 |
| 2021/0292823 A1* | 9/2021 | Zhang | C12Q 1/701 |

FOREIGN PATENT DOCUMENTS

| | | |
|---|---|---|
| WO | 2021067788 A1 | 4/2021 |
| WO | 2021074191 A1 | 4/2021 |

OTHER PUBLICATIONS

Pellenz (Human gene therapy 30.7 (2019): 814-828) (Year: 2019).*
Safari (Cell & bioscience 9.1 (2019): 36) (Year: 2019).*
Database UniProt Ratnikova N.M. et al. "Type V RISPR-associated protein Cpfl from sulfurimonas crateris" XP002808334 retrieved from EBI accession No. UNIPROT:AOA4U2Z946 [Online] Jul. 31, 2019.
International Search Report and Written Opinion for Application No. PCT/US21/51142 mailing date Feb. 14, 2023, 12 pages.
International Search Report and Written Opinion for PCT/US2022/028208, dated Oct. 24, 2022, 12 pages.
Rojek Johan et al., "Mad7: An IP friendly CRISPR enzyme", Authorea, Inc. Aug. 10, 2021, pp. 1-7.
Wierson, Wesley A. et al. Expanding the CRISPR Toolbox with ErCas12a in Zebrafish and Human Cells, The CRISPR Journal, vol. 2, No. 6, Dec. 1, 2019 pp. 417-433.

* cited by examiner

*Primary Examiner* — Neil P Hammell
*Assistant Examiner* — Kyle T Rega
(74) *Attorney, Agent, or Firm* — Ipsilon USA—NLO

(57) ABSTRACT
Embodiments disclosed herein include novel nucleic acid-guided nucleases, novel guide nucleic acids, and novel targetable nuclease systems, and methods of use. In some embodiments, engineered non-naturally occurring nucleic acid-guided nucleases, can be used with known guide nucleic acids in a targetable nuclease system. In certain embodiments, targetable nuclease systems can be used to edit targeted genomes of humans and other species. In some embodiments, methods include, but are not limited to, recursive genetic engineering and trackable genetic engineering methods.

20 Claims, 10 Drawing Sheets

Specification includes a Sequence Listing.

Depletion assay for ART1

Depletion assay for ART2

Depletion assay for ART6

Depletion assay for ART10

Depletion assay for ART11

GalK editing for ART2

CONSTRUCTS AND USES THEREOF FOR EFFICIENT AND SPECIFIC GENOME EDITING

CROSS-REFERENCE

This application claims the benefit of U.S. Provisional Application No. 63/080,552, filed Sep. 18, 2020, and of U.S. Provisional Application No. 63/185,315, filed May 6, 2021, which applications are incorporated herein by reference.

The instant application contains a Sequence Listing which has been submitted electronically in ASCII text format encoded as XML and is hereby incorporated by reference in its entirety. Said .XML file was created on Mar. 17, 2023 is named "ARTN-012.PCT.xml" and is 9.91 kB in size. The sequence listing contained in this .XML file is part of the specification and is hereby incorporated by reference herein in its entirety.

BACKGROUND

CRISPR is an abbreviation of Clustered Regularly Interspaced Short Palindromic Repeats. In a palindromic repeat, the sequence of nucleotides is the same in both directions. Each of these palindromic repetitions is followed by short segments of spacer DNA. Small clusters of Cas (CRISPR-associated system) genes are located next to CRISPR sequences. The CRISPR/Cas system is a prokaryotic immune system that can confer resistance to foreign genetic elements such as those present within plasmids and phages providing the prokaryote a form of acquired immunity. RNA harboring a spacer sequence assists Cas (CRISPR-associated) proteins to recognize and cut exogenous DNA. CRISPR sequences are found in approximately 50% of bacterial genomes and nearly 90% of sequenced archaea has selected for efficient and robust metabolic and regulatory networks that prevent unnecessary metabolite biosynthesis and optimally distribute resources to maximize overall cellular fitness. The complexity of these networks with limited approaches to understand their structure and function and the ability to re-program cellular networks to modify these systems for a diverse range of applications has complicated advances in this space. Certain approaches to re-program cellular networks are directed to modifying single genes of complex pathways but as a consequence of modifying single genes, unwanted modifications to the genes or other genes can result, getting in the way of identifying changes necessary to achieve a sought-after endpoint as well as complicating the endpoint sought by the modification.

CRISPR-Cas driven genome editing and engineering has dramatically impacted biology and biotechnology in general. CRISPR-Cas editing systems require a polynucleotide guided nuclease, a guide polynucleotide (e.g. a guide RNA (gRNA)) that directs the nuclease to cut a specific region of the genome, and, optionally, a donor DNA cassette that can be used to repair the cut dsDNA and thereby incorporate programmable edits at the site of interest. The earliest demonstrations and applications of CRISPR-Cas editing used Cas9 nucleases and associated gRNA. These systems have been used for gene editing in a broad range of species encompassing bacteria to higher order mammalian systems such as animals and in certain cases, humans. It is well established, however, that key editing parameters such as protospacer adjacent motif (PAM) specificity, editing efficiency, and off-target rates, among others, are species, loci, and nuclease dependent. There is increasing interest in identifying and rapidly characterizing novel nuclease systems that can be exploited to broaden and improve overall editing capabilities.

It is known that Cas12a is a single RNA-guided CRISPR/Cas endonuclease capable of genome editing having differing features when compared to Cas9. In certain embodiments, a Cas12a-based system allow fast and reliable introduction of donor DNA into a genome. In addition, Cas12a broadens genome editing. CRISPR/Cas12a genome editing has been evaluated in human cells as well as other organisms including plants. Several features of the CRISPR/Cas12a system are different when compared to CRISPR/Cas9.

It is known that Cas12a nuclease recognizes T-rich protospacer adjacent motif (PAM) sequences (e.g. 5'-TTTN-3' (AsCas12a, LbCas12a) and 5'-TTN-3' (FnCas12a); whereas, the comparable sequence for SpCas9 is NGG. The PAM sequence of Cas12a is located at the 5' end of the target DNA sequence, where it is at the 3' end for Cas9. In addition, Cas12a is capable of cleaving DNA distal to its PAM around the +18/+23 position of the protospacer. This cleavage creates a staggered DNA overhang (e.g. sticky ends), whereas Cas9 cleaves close to its PAM after the 3' position of the protospacer at both strands and creates blunt ends. In certain methods, creating altered recognition of nucleases can provide an improvement over Cas9 or Cas12a to improve accuracy. Further, Cas12a is guided by a single crRNA and does not require a tracrRNA, resulting in a shorter gRNA sequence than the sgRNA used by Cas9.

It is also known that Cas12a displays additional ribonuclease activity that functions in crRNA processing. Cas12a is used as an editing tool for different species (e.g. *S. cerevisiae*), allowing the use of an alternative PAM sequence compared with the one recognized by CRISPR/Cas9.

Well-known Cas12a protein-RNA complexes recognize a T-rich PAM and cleavage leads to a staggered DNA double-stranded break. Cas12a-type nuclease interacts with the pseudoknot structure formed by the 5'-handle of crRNA. A guide RNA segment, composed of a seed region and the 3' terminus, possesses complementary binding sequences with the target DNA sequences. Cas12a type nucleases characterized to date have been demonstrated to work with a single gRNA and to process gRNA arrays. While Cas12a-type and Cas9 nuclease systems have proven highly impactful, neither system has been demonstrated to function as predictably as is desired to enable the full range of applications envisioned for gene-editing technologies.

In the current state, a range of efforts have attempted to engineer improved CRISPR editing systems having increased efficiency and accuracy, which have included engineering of the PAM specificity, stability, and sequence of the gRNA and-or the nuclease. For example, chemical modifications of CRISPR/Cas9 gRNA expected to increase gRNA stability was found to lead to a 3.8-fold higher indel frequencies in human cells. In addition, other studies included structure-guided mutagenesis of Cas12a and screened to identify variants with an increased range of recognized PAM sequences. These engineered AsCas12a recognized TYCV and TATV PAMs in addition to the established TTTV sequence, with enhanced activities in vitro and in tested human cells.

One version of the CRISPR/Cas system, CRISPR/Cas9, has been modified to provide useful tools for editing targeted genomes. By delivering the Cas9 nuclease complexed with a synthetic guide RNA (gRNA) into a cell, the cell's genome can be cut/edited at a predetermined location, allowing existing genes to be removed and/or new ones added. These systems are useful but have some important limitations regarding efficiency and accuracy of targeted editing, imprecise editing complications, as well as, impediments when used for commercially relevant situations such as gene replacement. Therefore, a need exists for improved nucleic acid guided nuclease systems for directed and accurate editing with improved efficiency.

SUMMARY OF THE DISCLOSURE

Embodiment 1 provides a composition comprising (i) an engineered nucleic acid-guided nuclease comprising an engineered nuclease polypeptide comprising an amino acid sequence having at least 60% sequence identity to any one of SEQ ID NO: 143-177 and 229, or a polynucleotide or polynucleotides encoding an amino acid sequence having at least 60% sequence identity to any one of SEQ ID NO: 143-177 and 229. Embodiment 2. The composition of embodiment 1 comprising an engineered nuclease polypeptide comprising an amino acid sequence having at least 60% sequence identity to any one of SEQ ID NO: 144, 153, and 229, or a polynucleotide or polynucleotides encoding an amino acid sequence having at least 60% sequence identity to any one of SEQ ID NO: 144, 153, and 229. Embodiment 3. The composition of embodiments 1 or 2 comprising an engineered nuclease polypeptide comprising an amino acid sequence having at least 60% sequence identity to SEQ ID NO: 144 or a polynucleotide or polynucleotides encoding an amino acid sequence having at least 60% sequence identity to SEQ ID NO: 144. Embodiment 4. The composition of any previous claim comprising an engineered nuclease polypeptide comprising an amino acid sequence having at least 60% sequence identity to SEQ ID NO: 153 or a polynucleotide or polynucleotides encoding an amino acid sequence having at least 60% sequence identity to SEQ ID NO: 153. Embodiment 5. The composition of any previous claim comprising an engineered nuclease polypeptide comprising an amino acid sequence having at least 60% sequence identity to SEQ ID NO: 229 or a polynucleotide or polynucleotides encoding an amino acid sequence having at least 60% sequence identity to SEQ ID NO: 229. Embodiment 6. The composition of any previous Embodiment wherein the sequence identity is at least 80%. Embodiment 7. The composition of any previous Embodiment wherein the sequence identity is at least 95%. Embodiment 8. The composition of any previous Embodiment wherein the sequence identity is 100%. Embodiment 9. The composition of Embodiment 1 wherein the engineered nuclease polypeptide does not contain the peptide motif YLFQIYNKDF (SEQ ID NO. 224) or a polynucleotide or polynucleotides encoding the engineered nuclease polypeptide that does not contain the peptide motif YLFQIYNKDF (SEQ ID NO. 224).Embodiment 10. The composition of Embodiment 9 comprising an amino acid sequence having at least 60% sequence identity to any one of SEQ ID NO: 143-151, 161-163, 165, 166, 169, 171-175, 177, and 229 or a polynucleotide or polynucleotides encoding an amino acid sequence having at least 60% sequence identity to any one of SEQ ID NO: 143-151, 161-163, 165, 166, 169, 171-175, 177, and 229.Embodiment 11. The composition of Embodiment 10 comprising an amino acid sequence having at least 60% sequence identity to any one of SEQ ID NO: 149, 151, 175, and 177 or a polynucleotide or polynucleotides encoding an amino acid sequence having at least 60% sequence identity to any one of SEQ ID NO: 149, 151, 175, and 177.Embodiment 12. A composition comprising a targetable guide nucleic acid-guided nuclease complex comprising an engineered guide nucleic acid nuclease of any previous Embodiment and further comprising (ii) a compatible guide nucleic acid. Embodiment 13. The composition of Embodiment 12 wherein the guide nucleic acid is a gRNA and the complex is an RNP. Embodiment 14. The composition of Embodiment 12 or 13 wherein the guide nucleic acid is a split guide nucleic acid.Embodiment 15. The composition of Embodiment 13 or 14 wherein the gRNA is an engineered gRNA-.Embodiment 16. The composition of Embodiment 15 wherein the engineered gRNA comprises a conserved gRNA.Embodiment 17. The composition of Embodiment 16 wherein the conserved gRNA comprises any one of SEQ ID NO: 291-325, or a portion thereof.Embodiment 18. The composition of Embodiment 17 wherein the conserved gRNA comprises a portion of any one of SEQ ID NO: 291-325.Embodiment 19. The composition of Embodiment 18 wherein the portion is a highly conserved portion comprising a nucleotide sequence for secondary structure of the RNA.Embodiment 20. The composition of Embodiment 18 wherein the secondary structure comprises a pseudoknot. Embodiment 21. The composition of any of Embodiments 13 to 20 wherein the gRNA is a synthetic gRNA.Embodiment 22. The composition of Embodiment 21 wherein the gRNA comprises one or more chemical modifications.Embodiment 23. A method of creating a strand break at or near a target sequence in a target polynucleotide comprising contacting the target sequence with a targetable nucleic acid-guided nuclease complex of any one of Embodiment 12-22, wherein the compatible guide nucleic acid of the complex targets the target sequence, and allowing the targetable guide nucleic acid-guided nuclease complex to create the strand break. Embodiment 24. The method of Embodiment 23 wherein the target polynucleotide is in a cellular genome.Embodiment 25. The method of Embodiment 23 or 24 further comprising providing an editing template to be inserted in the target sequence.Embodiment 26. The method of Embodiment 25 wherein the editing template comprises a transgene. Embodiment 27. The method of any of Embodiment 23-27 wherein the target polynucleotide is a safe harbor site.Embodiment 28. A cell created by the Embodiment of embodiment 23.Embodiment 29. An organism created by the method of Embodiment 23. Embodiment 30. A composition comprising an engineered polynucleotide or polynucleotides comprising one or more polynucleotides comprising a sequence corresponding to a sequence with at least 60% sequence identity to any one of SEQ ID NO: SEQ ID NO: 1-142 and 225-228.Embodiment 31. The composition of Embodiment 30 comprising one or more polynucleotides comprising a sequence corresponding to a sequence with at least 60% sequence identity to any one of SEQ ID NO: 1, 5, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, and 225.Embodiment 32. The composition of Embodiment 30 or 31 wherein the polynucleotide codes for one or more additional amino acid sequences at either the N-terminus, the C-terminus or both, of a polypeptide encoded by the polynucleotide.Embodiment 33. The composition of Embodiment 32 wherein the additional amino acid sequences comprise at least one of (i) one or more NLSs; (ii) one or more purification tags; (iii) one or cleavage sequences; and (iv) FLAG or 3XFLAGEmbodiment 34. The composition of Embodiment 32 wherein the additional amino acid sequences comprise at least two of (i) one or more NLSs; (ii) one or more purification tags; (iii) one or cleavage sequences; and (iv) FLAG or 3XFLAGEmbodiment 35. The composition of Embodiment 32 wherein the additional amino acid sequences comprise at least three of (i) one or more NLSs; (ii) one or more purification tags; (iii) one or cleavage sequences; and (iv) FLAG or 3XFLAG-Embodiment 36. The composition of Embodiment 32 wherein the additional amino acid sequences comprise (i) one or more NLSs (ii) one or more purification tags (iii) one or cleavage sequences; an (iv) FLAG or 3XFLAGEmbodiment 37. The composition of any of Embodiment 30-36 wherein the polynucleotide or polynucleotides are codon optimized. Embodiment 38. The composition of Embodiment 37 wherein the polynucleotide or polynucleotides are codon optimized for E. coli.Embodiment 39. The composition of Embodiment 39 comprising one or more polynucleotides comprising a sequence corresponding to a sequence with at least 60% sequence identity to any of SEQ ID NO: 2, 6, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 226, and 330.Embodiment 40. The composition of Embodiment 37 wherein the polynucleotide or polynucleotides are codon optimized for S cerivisiae.Embodiment 41. The composition of Embodiment 40 comprising one or more polynucleotides comprising a sequence corresponding to a sequence with at least 60% sequence identity to any of SEQ ID NO: 3, 7, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, and 227.Embodiment 42. The composition of Embodiment 37 wherein the polynucleotide or polynucleotides are codon optimized for human. Embodiment 43. The composition of Embodiment 42 comprising one or more polynucleotides comprising a sequence corresponding to a sequence with at least 60% sequence identity to any of SEQ ID NO: 3, 7, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, and 227Embodiment 44. The composition of any of Embodiments 30-43 wherein the sequence identity is at least 80%. Embodiment 45. The composition of any of Embodiments 30-43 wherein the sequence identity is at least 95%. Embodiment 46. The composition of any of Embodiments 30-43 wherein the sequence identity is 100%

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The following drawings form part of the present specification and are included to further demonstrate certain embodiments of the present disclosure. Certain embodiments can be better understood by reference to one or more of these drawings in combination with the detailed description of specific embodiments presented herein.

DETAILED DESCRIPTION

Figure 1:
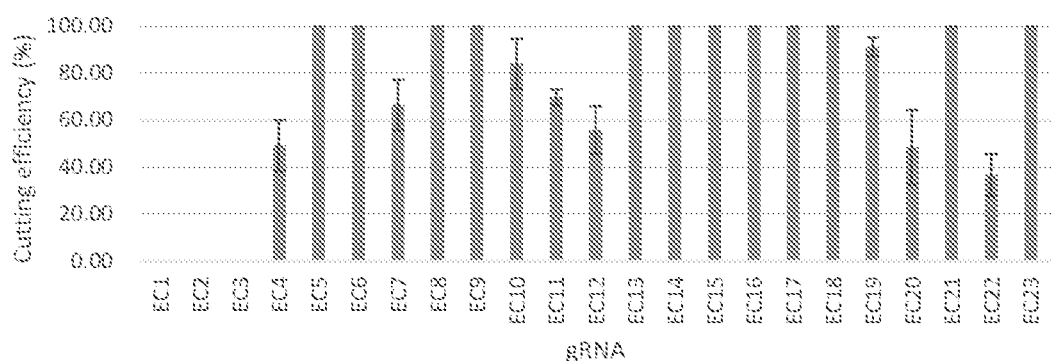
FIG. 1 is an exemplary graph illustrating a depletion assay to assess cutting efficiency of an ART1 nucleic acid-guided nuclease of some embodiments disclosed herein.
Figure 2:
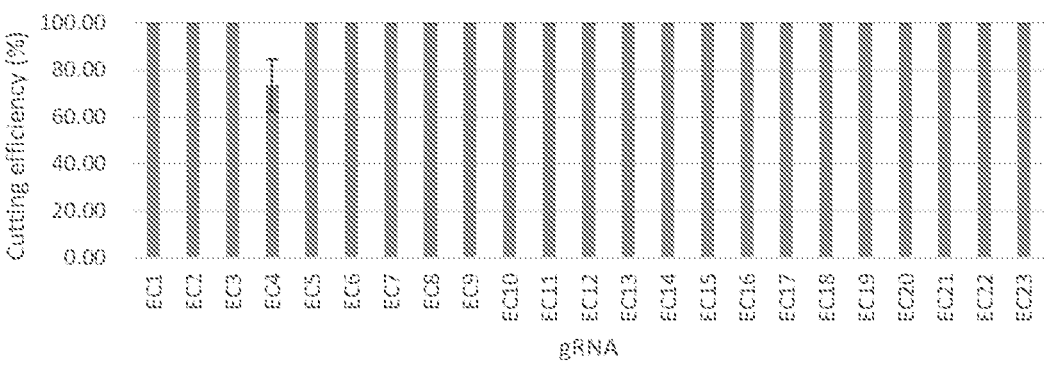
FIG. 2 is an exemplary graph illustrating a depletion assay to assess cutting efficiency of an ART2 nucleic acid-guided nuclease of some embodiments disclosed herein.
Figures 3, 4:
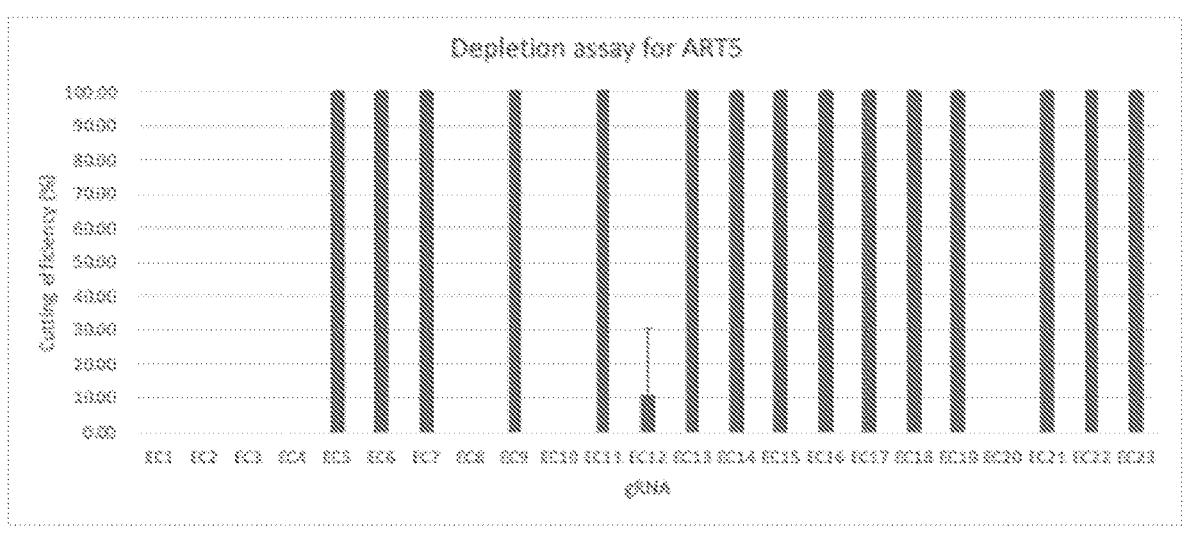
FIG. 3 is an exemplary graph illustrating a depletion assay to assess cutting efficiency of an ART5 nucleic acid-guided nuclease of some embodiments disclosed herein.
FIG. 4 is an exemplary graph illustrating a depletion assay to assess cutting efficiency of an ART6 nucleic acid-guided nuclease of some embodiments disclosed herein.
Figure 5:
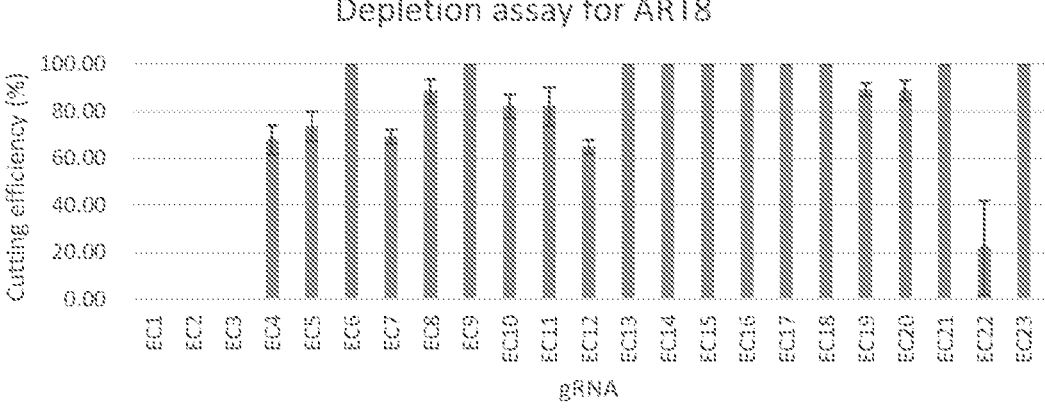
FIG. 5 is an exemplary graph illustrating a depletion assay to assess cutting efficiency of an ART8 nucleic acid-guided nuclease of some embodiments disclosed herein.
Figure 6:
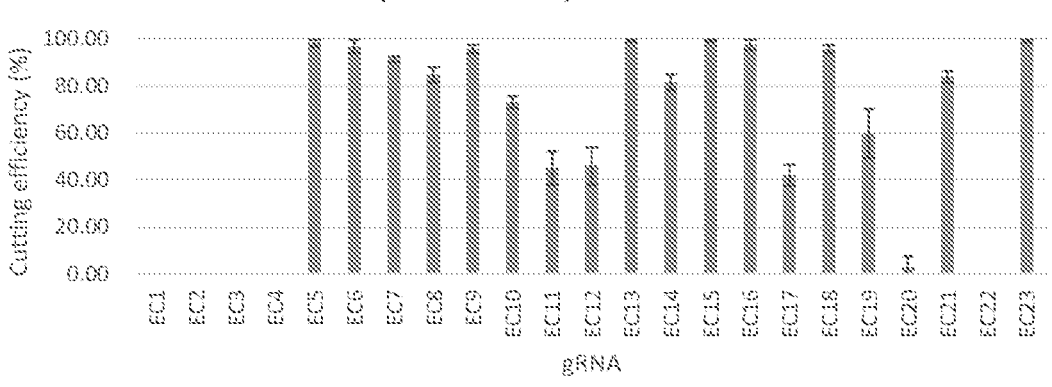
FIG. 6 is an exemplary graph illustrating a depletion assay to assess cutting efficiency of an ART9 nucleic acid-guided nuclease of some embodiments disclosed herein.
Figure 7:
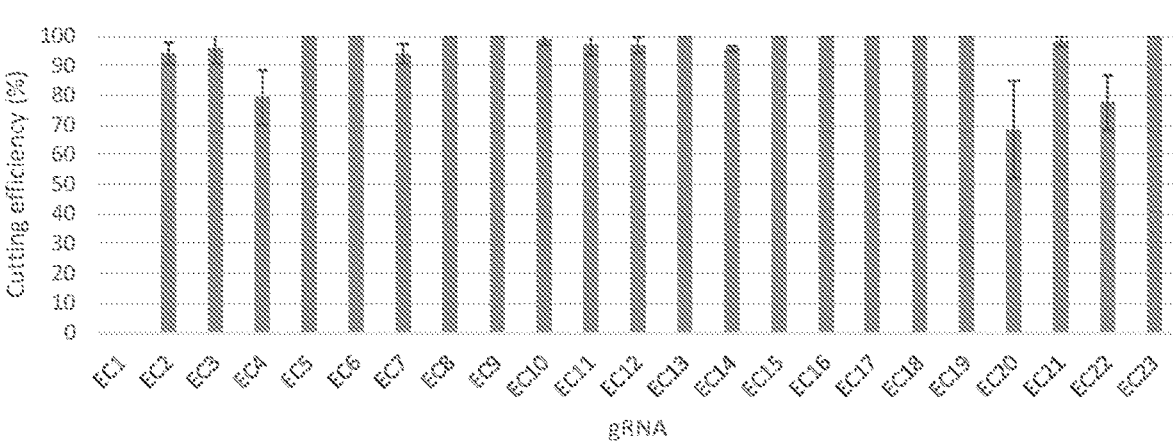
FIG. 7 is an exemplary graph illustrating a depletion assay to assess cutting efficiency of an ART10 nucleic acid-guided nuclease of some embodiments disclosed herein.
Figure 8:
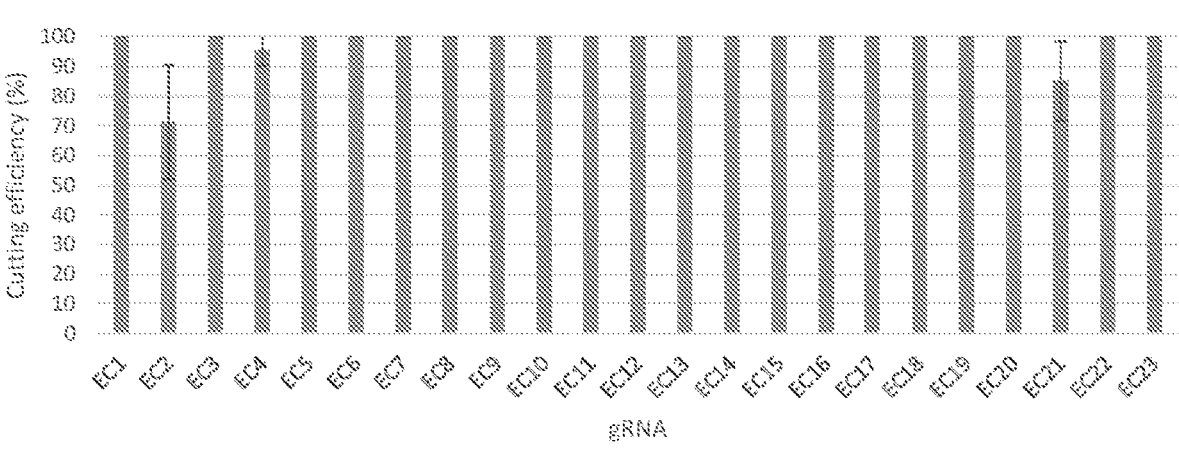
FIG. 8 is an exemplary graph illustrating a depletion assay to assess cutting efficiency of an ART11 nucleic acid-guided nuclease of some embodiments disclosed herein.
Figure 9:
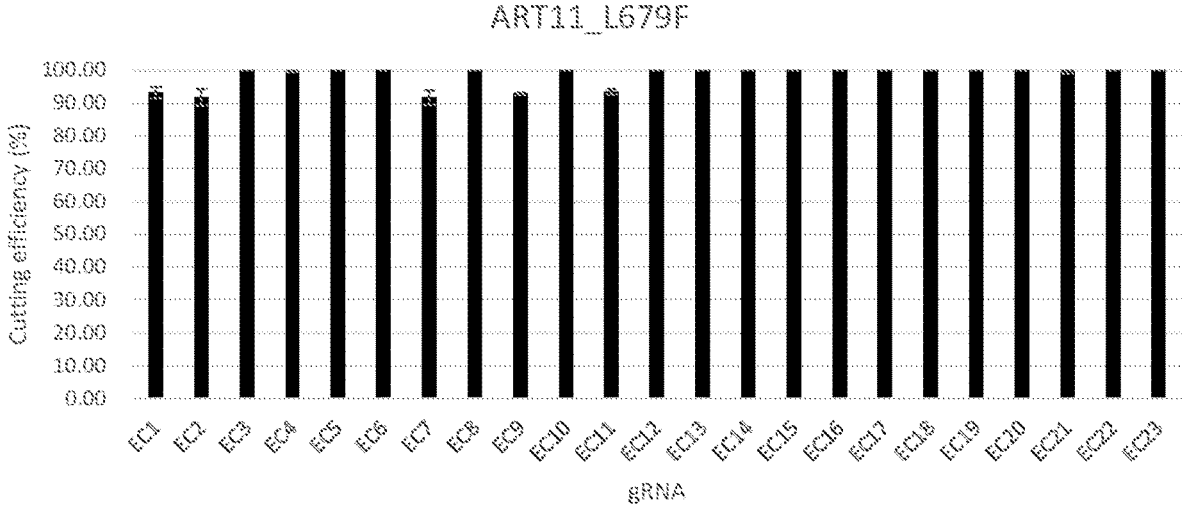
FIG. 9 is an exemplary graph illustrating a depletion assay to assess cutting efficiency of an ART11 L679F (ART11*) nucleic acid-guided nuclease of some embodiments disclosed herein

Some embodiments disclosed herein concern novel nucleic acid-guided nucleases, guide nucleic acids (e.g. gRNAs), and targetable nuclease systems, and methods of use. In other embodiments, methods for making and using engineered non-naturally occurring nucleic acid-guided nucleases, guide nucleic acids, and targetable nuclease systems are disclosed. In some embodiments, targetable nuclease systems can be used to edit human genomes or genomes of other species. In some embodiments, nucleic acid-guided nucleases can include polypeptides having an amino acid sequence, e.g. a sequence represented by SEQ ID NO: 143-177 and 229; In embodiments, nucleic acid-guided nucleases can include polynucleotides encoding the nucleases, e.g., polynucleotides having a nucleic acid sequence represented by SEQ ID NO: 1-142 and 225-228. In embodiments, gRNAs can include a gRNA represented by one or more of SEQ ID NO: 178-188. In other embodiments, gRNAs can be represented by SEQ ID NO: 178-188. In other embodiments, gRNAs can include a split gRNA of use as a synthetic tracrRNA and cfRNA for methods and systems disclosed herein. Other sequences of use in embodiments disclosed herein are provided below.

In the following sections, various exemplary compositions and methods are described in order to detail various embodiments of the disclosure. It will be obvious to one of skill in the relevant art that practicing the various embodiments does not require the employment of all or even some of the details outlined herein, but rather that concentrations, times and other details may be modified through routine experimentation. In some cases, well-known methods or components have not been included in the description.

As used herein, the term "modulating" and "manipulating" of genome editing can mean an increase, a decrease, upregulation, downregulation, induction, a change in editing activity, a change in binding, a change cleavage or the like, of one or more of targeted genes or gene clusters of certain embodiments disclosed herein.

In certain embodiments of the present disclosure, there can be employed conventional molecular biology, microbiology, and recombinant DNA techniques within the skill of the art. Such techniques are explained fully in the literature and understood by those of skill in the art. In other embodiments, primers used herein for preparation per conventional techniques can include sequencing primers and amplification primers. In some embodiments, plasmids and oligomers used in conventional techniques can include synthesized oligomers and oligomer cassettes.

In some embodiments disclosed herein, nucleic acid-guided nuclease systems and methods of use are provided. A nuclease system can include transcripts and other elements involved in the expression of an engineered nuclease disclosed herein, which can include sequences encoding a novel engineered nucleic acid-guided nuclease protein and a guide sequence (gNA, e.g., gRNA) or a novel gNA, e.g., novel gRNA as disclosed herein. In some embodiments, nucleic acid-guided nuclease systems can include at least one CRISPR-associated nucleic acid guided nuclease construct, the disclosure of which are provided herein. In other embodiments, nucleic acid-guided nuclease systems can include at least one known sequence, e.g., at least one known guide sequence or at least one known scaffold sequence in a gNA (e.g., gRNA) or at least one novel gNA, e.g., gRNA. In some embodiments, an engineered nucleic acid-guided nuclease of the instant invention can be used in systems for editing a gene of interest in humans or other species.

Bacterial and archaeal targetable nuclease systems have emerged as powerful tools for precision genome editing. However, naturally occurring nucleases have some limitations including expression and delivery challenges due to the nucleic acid sequence and protein size. In certain embodiments, novel engineered nucleic acid-guided nuclease constructs disclosed herein can be created for altered targeting of a targeted gene and/or increased efficiency and/or accuracy of targeted gene editing in a subject. Other uses for novel engineered nucleic acid-guided nuclease constructs disclosed herein can be, e.g., those disclosed herein.

In accordance with these embodiments, it is known that Cas12a is a single RNA-guided CRISPR/Cas endonuclease capable of genome editing having differing features when compared to Cas9. In certain embodiments, a Cas12a-based system allow fast and reliable introduction of donor DNA into a genome. In addition, Cas12a broadens genome editing. CRISPR/Cas12a genome editing has been evaluated in human cells as well as other organisms including plants. Several features of the CRISPR/Cas12a system are different when compared to CRISPR/Cas9.

It is known that Cas12a nuclease recognizes T-rich protospacer adjacent motif (PAM) sequences (e.g. 5'-TTTN-3' (AsCas12a, LbCas12a) and 5'-TTN-3' (FnCas12a); whereas, the comparable sequence for SpCas9 is NGG. The PAM sequence of Cas12a is located at the 5' end of the target DNA sequence, where it is at the 3' end for Cas9. In addition, Cas12a is capable of cleaving DNA distal to its PAM around the +18/+23 position of the protospacer. This cleavage creates a staggered DNA overhang (e.g. sticky ends), whereas Cas9 cleaves close to its PAM after the 3' position of the protospacer at both strands and creates blunt ends. In certain methods, creating altered recognition of nucleases can provide an improvement over Cas9 or Cas12a to improve accuracy. Further, in certain embodiments herein, Cas12a can be guided by a single crRNA (gRNA) and does not require a tracrRNA, resulting in a shorter gRNA sequence than the sgRNA used by Cas9; in certain embodiments herein, Cas12a can be guided by a split gRNA, e.g., a split gRNA that is a synthesized gRNA, a split gRNA comprising modulated nucleotides, or other engineered split gRNA, rather than by a single gRNA as seen in Cas12a; or other engineered split gRNA as disclosed herein.

It is also known that Cas12a displays additional ribonuclease activity that functions in crRNA (gRNA, e.g., split gRNA such as an engineered split gRNA) processing. Cas12a is used as an editing tool for different species (e.g. *S. cerevisiae*), allowing the use of an alternative PAM sequence compared with the one recognized by CRISPR/Cas9. Novel nucleases disclosed herein can further recognize the same or alternative PAM sequences. These novel nucleases can provide an alternative system for multiplex genome editing as compared with known multiplex approaches and can be used as an improved system in mammalian gene editing. Other implications of gRNA processing can be as discussed herein, e.g., production of a gRNA, e.g., split gRNA such as an engineered split gRNA, that comprises a conserved or highly conserved RNA sequence, which can be a sequence important to secondary structure in an RNA for a particular nuclease, e.g., secondary structure such as a pseudoknot region, and or other implications as discussed herein.

Well-known Cas12a protein-RNA complexes recognize a T-rich PAM and cleavage leads to a staggered DNA double-stranded break. Cas12a-type nuclease interacts with the pseudoknot structure formed by the 5'-handle of crRNA. A guide RNA segment, composed of a seed region and the 3' terminus, possesses complementary binding sequences with the target DNA sequences. Cas12a type nucleases characterized to date have been demonstrated to work with a single gRNA and to process gRNA arrays. While Cas12a-type and Cas9 nuclease systems have proven highly impactful, neither system has been demonstrated to function as predictably as is desired to enable the full range of applications envisioned for gene-editing technologies.

In the current state, a range of efforts have attempted to engineer improved CRISPR editing systems having increased efficiency and accuracy, which have included engineering of the PAM specificity, stability, and sequence of the gRNA and-or the nuclease. For example, chemical modifications of CRISPR/Cas9 gRNA expected to increase gRNA stability was found to lead to a 3.8-fold higher indel frequencies in human cells. In addition, other studies included structure-guided mutagenesis of Cas12a and screened to identify variants with an increased range of recognized PAM sequences. These engineered AsCas 12a recognized TYCV and TATV PAMs in addition to the established TTTV sequence, with enhanced activities in vitro and in tested human cells.

Cas12a-like nucleases and engineered Cas12a-like nucleases (engineered designer nucleases) and gNAs, e.g., gRNAs such as engineered gNAs, e.g., gRNAs disclosed herein are contemplated of use in bacteria, other prokaryotes. In other embodiments, engineered designer nucleases are contemplated of use in eukaryotes such as single celled eukaryotes, e.g., yeast, mammals as well as of use in birds and fish. In certain embodiments, engineered designer nucleases are contemplated for use in human cells. In accordance with these embodiments, these constructs are created in order to, e.g., alter certain features of the wild-type gRNA sequences while preserving other desirable features compared to the control the gRNAs are derived from.

In certain embodiments, engineered gRNA constructs of embodiments disclosed herein can be created from Cas12as gRNAs known in the art or not yet discovered and can include, but are not limited to, *Acidaminococcus massiliensis* sp. (e.g. AM_Cas12a strain Marseille-P2828), *Sedimentisphaera cyanobacteriorum* sp. (SC_Cas12a, strain L21-RPul-D3), *Barnesiella* sp. An22 (B_Cas12a; An22 An22), *Bacteroidetes bacterium HGW-Bacteroidetes-6* sp. XS5, (BB_Cas12a, 08E140C01), *Parabacteroides distasonis* sp. (PD_Cas12a, strain 8-P5) *Collinsella tanakaei* sp. (CT_Cas12a, isolate CIM: MAG 294), Lachnospiraceae bacterium MC2017 sp. (LB_Cas12a, T350), *Coprococcus* sp. AF16-5 (Co_Cas12a, AF16-5 AF16-5.Scaf1), or *Catenovulum* sp. CCB-QB4 (Ca_Cas12a, species CCB-QB4) *Eubacterium* rectale, (a positive control is a derivative of this Cas12a), *Flavobacterium branchiophilum* (FB_Cas12a), and/or a synthetic construct (SC_Cas12a) or similar. In certain embodiments, constructs can include 60% or less identity to the known Cas12as to create a novel nuclease. In certain embodiments, novel Cas12a derived constructs can include constructs with reduced off-targeting rates and/or improved editing functions compared to a control or wild-type Cas12a nuclease.

In some embodiments, off-targeting rates for nuclease constructs disclosed herein can be reduced compared to a control for improved editing. For example, off-targeting rates can be readily tested. In accordance with these embodiments, a wild-type gRNA plasmid can be used to assess baseline off-target editing compared to experimentally designed gRNAs to assess accuracy of novel nucleases compared to control Cas12a nucleases or other nucleases known in the art as a positive control (e.g. MAD7). In some embodiments, nuclease constructs disclosed herein can share conserved encoded motifs of known nucleases. In other embodiments, nuclease constructs disclosed herein do not share conserved encoded peptide motifs with known nucleases. In certain embodiments, nuclease constructs disclosed herein do not encode the peptide motif YLFQIYNKDF (SEQ ID NO. 224) within the encoded nuclease. In certain embodiments, nucleic acid-guided nuclease constructs disclosed herein do not encode the peptide motif YLFQIYNKDF and can include polypeptides represented by SEQ ID NO. 143-151, 161-163, 165, 166, 169, 171-175, 177, and 229. In other embodiments, nucleic acid-guided nuclease construct polypeptides disclosed herein include the peptide motif YLFQIYNKDF (SEQ ID NO. 224). In some embodiments, nucleic acid-guided nuclease construct polypeptides disclosed herein include the peptide motif YLFQIYNKDF and can be represented by the polypeptide represented by SEQ ID NO. 152-160, 164, 167, 168, 170, and 176.

In certain methods, spacer mutations can be introduced to a plasmid to test when a substitution gRNA sequence is created or a deletion or insertion mutant. Each of these plasmid constructs can be used to test genome editing accuracy and efficiency, for example, with deletions, substitutions or insertions.

Alternatively, nuclease constructs created by compositions and methods disclosed herein can be tested for optimal genome editing time on a select target by observing editing efficiencies over pre-determined time periods.

Examples of target polynucleotides for use of engineered nucleic acid guided nucleases disclosed herein can include a sequence/gene or gene segment associated with a signaling biochemical pathway, e.g., a signaling biochemical pathway-associated gene or polynucleotide. Other embodiments contemplated herein concern examples of target polynucleotides related to a disease-associated gene or polynucleotide.

A "disease-associated" or "disorder-associated" gene or polynucleotide can refer to any gene or polynucleotide which results in a transcription or translation product at an abnormal level compared to a control or leads to an abnormal form in cells derived from disease-affected tissues compared with tissues or cells of a non-disease control. It may be a gene that becomes expressed at an abnormally high level; it may be a gene that becomes expressed at an abnormally low level, or where the gene contains one or more mutations and where altered expression or expression directly correlates with the occurrence and/or progression of a health condition or disorder. A disease or disorder-associated gene can refer to a gene possessing mutation(s) or genetic variation that are directly responsible or is in linkage disequilibrium with a gene(s) that is responsible for the cause or progression of a disease or disorder. The transcribed or translated products may be known or unknown, and may be at a normal or abnormal level.

It is understood by one of skill in the relevant art that examples of disease-associated genes and polynucleotides are available from. McKusick-Nathans Institute of Genetic Medicine, Johns Hopkins University (Baltimore, Md.) and National Center for Biotechnology Information, National Library of Medicine (Bethesda, Md.), available on the World Wide Web. Further examples of genetic disorders and disorder-associated conditions, genetic disorders, or disclosed herein.

Genetic Disorders contemplated herein can include, but are not limited to:

Neoplasia: Genes linked to this disorder: PTEN; ATM; ATR; EGFR; ERBB2; ERBB3; ERBB4; Notch1; Notch2; Notch3; Notch4; AKT; AKT2; AKT3; HIF; HIFI a; HIF3a; Met; HRG; Bc12; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bc12; caspases family (9 members: 1, 2, 3, 4, 6, 7, 8, 9, 12); Kras; Apc;

Age-related Macular Degeneration: Genes linked to these disorders Aber; Cc12; Cc2; cp (cemloplasmin); Timp3; cathepsinD; VId1r; Ccr2;

Schizophrenia Disorders: Genes linked to this disorder: Neuregulin1 (Nrg1); Erb4 (receptor for Neuregulin); Complexin1 (Cp1×1); Tph1 Tryptophan hydroxylase; Tph2 Tryptophan hydroxylase 2; Neurexin 1; GSK3; GSK3a; GSK3b;

Trinucleotide Repeat Disorders: Genes linked to this disorder: 5 HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP-global instability); VLDLR (Alzheimer's); Atxn7; Atxn10;

Fragile X Syndrome: Genes linked to this disorder: FMR2; FXR1; FXR2; mGLURS;

Secretase Related Disorders: Genes linked to this disorder: APH-1 (alpha and beta); Presenil n (Psenl); nicastrin (Ncstn); PEN-2;

Others: Genes linked to this disorder: Nos1; Paip1; Nati; Nat2;

Prion-related disorders: Gene linked to this disorder: Prp;

ALS: Genes linked to this disorder: SOD1; ALS2; STEX; FUS; TARDBP; VEGF (VEGF-a; VEGF-b; VEGF-c);

Drug addiction: Genes linked to this disorder: Prkce (alcohol); Drd2; Drd4; ABAT (alcohol); GRIA2; GrmS; Grin1; Htr1b; Grin2a; Drd3; Pdyn; Grial (alcohol);

Autism: Genes linked to this disorder: Mecp2; BZRAP1; MDGA2; SemaSA; Neurexin 1; Fragile X (FMR2 (AFF2); FXR1; FXR2; MglurS);

Alzheimer's Disease Genes linked to this disorder: E1; CHIP; UCH; UBB; Tau; LRP; PICALM; Clusterin; PS1; SORL1; CR1; Vld1r; Uba1; Uba3; CHIP28 (Aqp1, Aquaporin 1); Uch11; Uch13; APP;

Inflammation and Immune-related disorders Genes linked to this disorder: IL-10; IL-1 (IL-1a; IL-1b); IL-13; IL-17 (IL-17a (CTLA8); IL-17b; IL-17c; IL-17d; IL-17f); 11-23; Cx3cr1; ptpn22; TNFa; NOD2/CARD15 for IBD; IL-6; IL-12 (IL-12a; IL-12b); CTLA4; Cx3cl1, AAT deficiency/mutations, AIDS (KIR3DL1, NKAT3, NKB1, ANIB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD4OLG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), 11-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs) (JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4);

Parkinson's, Genes linked to this disorder: x-Synuclein; DJ-1; LRRK2; Parkin; PINK1;

Blood and coagulation disorders: Genes linked to these disorders: Anemia (CDAN1, CDA1, RPS19, DBA, PKLR, PK1, NT5C3, UMPH I, PSN1, RHAG, RH50A, NRAMP2, SPTB, ALAS2, ANH I, ASB, ABCB7, ABC7, ASAT); Bare lymphocyte syndrome (TAPBP, TPSN, TAP2, ABCB3, PSF2, RINGI 1, MHC2TA, C2TA, RFX5, RFXAP, RFX5), Bleeding disorders (TBXA2R, P2RX I, P2X I); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, ICIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1);

Cell dysregulation and oncology disorders: Genes linked to these disorders: B-cell non-Hodgkin lymphoma (BCL7A, BCL7); Leukemia (TALI TCL5, SCL, TAL2, FLT3, NBS 1, NBS, ZNFNIAI, IK1, LYF1, HOXD4, HOX4B, BCR, CML, PHL, ALL, ARNT, KRAS2, RASK2, GMPS, AFIO, ARHGEFI2, LARG, KIAA0382, CALM, CLTH, CEBPA, CEBP, CHIC2, BTL, FLT3, KIT, PBT, LPP, NPM1, NUP214, D9S46E, CAN, CAIN, RUNX 1, CBFA2, AML1, WHSC 1 LI, NSD3, FLT3, AFIQ, NPM 1, NUMA1, ZNF145, PLZF, PML, MYL, STAT5B, AFI 0, CALM, CLTH, ARLI 1, ARLTS1, P2RX7, P2X7, BCR, CML, PHL, ALL, GRAF, NFI, VRNF, WSS, NFNS, PTPNI 1, PTP2C, SHP2, NS 1, BCL2, CCND1, PRAD1, BCL1, TCRA, GATA1, GF1, ERYF1, NFE1, ABL1, NQO1, DIA4, NMOR1, NUP2I4, D9S46E, CAN, CAIN);

Metabolic, liver, kidney disorders: Genes linked to these disorders: Amyloid neuropathy (TTR, PALS); Amyloidosis (APOA1, APP, AAA, CVAP, AD1, GSN, FGA, LYZ, UR, PALS); Cirrhosis (KATI 8, KRT8, CaHIA, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPS, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD2, PKD4, PKDTS, PRKCSH, G19P1, PCLD, SEC63);

Muscular/Skeletal Disorders: Genes linked to these disorders: Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDCID, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMDIN, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LAPS, BMND1, LRP7, LR3, OPPG, VBCH2, CLCN7, CLC7, OPTA2, OSTMI, GL, TCIRG1, TIRC7, 0C116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1);

Neurological and Neuronal disorders: Genes linked to these disorders: ALS (SOD1, ALS2, STEX, FUS, TAR- DBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCPI, ACEI, MPO, PACIP1, PAXIPIL, PTIP, A2M, BLMH, BMH, PSEN1, AD3); Autism (Mecp2, BZRAP I, MDGA2, Sema5A, Neurex 1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARKS, PINK1, PARK6, UCHL1, PARKS, SNCA, NACP, PARK1, PARK4, PRKN, PARK-2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cp1×1), Tph1 Tryptophan hydroxylase, Tph2, Tryptophan hydroxylase 2, Neurexin 1, GSK3, GSK3a, GSK3b, 5-HTT (S1c6a4), COMT, DRD (Drd 1a), SLC6A3, DAOA, DTNBP1, Dao (Daol)); Secretase Related Disorders (APH-1 (alpha and beta), Preseni I in (Psenl), nicastrin, (Ncstn), PEN-2, Nos1, Parpl, Nat1, Nat2); Trinucleotide Repeat Disorders (HTT (Huntington's Dx), SBMA/SMAX1/AR (Kennedy's Dx), FXN/X25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP-global instability), VLDLR (Alzheimer's), Atxn7, Atxn10);

Occular-related disorders: Genes linked to these disorders: Age-related macular degeneration (Aber, Cc12, Cc2, cp (ceruloplasmin), Timp3, cathepsinD, Vld1r, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQPO, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, MIS1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLCIA, JOAG, GPOA, OPTN, GLCIE, FIP2, HYPL, NRP, CYP1B1, GLC3A, OPAL, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2);

P13K/AKT Cellular Signaling disorders: Genes linked to these disorders: PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKNIB; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB;

DYRKIA; CDKNIA; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SOK; HS P90AA1; RP S 6KB1;

ERK/MAPK Cellular Signaling disorders: Genes linked to these disorders: PRKCE; ITGAM; ITGA5; HSPB1; IRAK1; PRKAA2; EIF2AK2; RAC1; RAPIA; TLN1; EIF4E; ELK1; GRK6; MAPK1; RAC2; PLK1; AKT2; PIK3CA; CDK8; CREB1; PRKC1; PTK2; FOS; RPS6KA4; PIK3CB; PPP2RIA; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRKIA; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAE; ATF4; PRKCA; SRF; STAT1; SGK;

Glucocorticoid Receptor Cellular Signaling disorders: Genes linked to these disorders: RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKNIC; TRAF2; SERPINE1; NCOA3; MAPK14; TNF; RAF1; IKBKG; MAP3K7; CREBBP; CDKNIA; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP 1; STAT1; IL6; HSP90AA1;

Axonal Guidance Cellular Signaling disorders: Genes linked to these disorders: PRKCE; ITGAM; ROCK1; ITGA5; CXCR4; ADAM12; IGF1; RAC1; RAPIA; E1 F4E; PRKCZ; NRP1; NTRK2; ARHGEF7; SMO; ROCK2; MAPK1; PGF; RAC2; PTPN11; GNAS; AKT2; PIK3CA; ERBB2; PRKC1; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GUI; WNT5A; ADAM10; MAP2K1; PAK3; ITGB3; CDC42; VEGFA; ITGA2; EPHA8; CRKL; RND1; GSK3B; AKT3; PRKCA;

Ephrin Recptor Cellular Signaling disorders: Genes linked to these disorders: PRKCE; ITGAM; ROCK1; ITGA5; CXCR4; IRAK1; PRKAA2; EIF2AK2; RAC1; RAPIA; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRKIA; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK;

Actin Cytoskeleton Cellular Signaling disorders: Genes linked to these disorders: ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD;

PRKAA1; MAPK9; CDK2; PIM1; PIK3C2A; ITGB7; PPP1CC; PXN; VIL2; RAF1; GSN; DYRKIA; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK;

Huntington's Disease Cellular Signaling disorders: Genes linked to these disorders: PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKC1; HS PA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3;

Apoptosis Cellular Signaling disorders: Genes linked to these disorders: PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRKIA; MAP2K2; CHUK; APAF1; MAP2K1; NFKB1; PAK3; LMNA; CASP2; BIRC2; TTK; CSNKIA1; BRAF; BAX; PRKCA; SGK; CASP3: BTRC3: PARPI;

B Cell Receptor Cellular Signaling disorders: Genes linked to these disorders: RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1;

Leukocyte Extravasation Cellular Signaling disorders: Genes linked to these disorders: ACTN4; CD44; PRKCE; ITGAM; ROCK1; CXCR4; CYBA; RAC1; RAPIA; PRKCZ; ROCK2; RAC2; PTPN11; MMP14; PIK3CA; PRKC1; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; FUR; ITK; CRKL; VAV3; CTTN; PRKCA; MMPI; MMP9;

Integrin Cellular Signaling disorders: Genes linked to these disorders: ACTN4; ITGAM; ROCK1; ITGA5; RAC1; PTEN; RAPIA; TLN1; ARHGEF7; MAPK1; RAC2; CAPNS1; AKT2; CAPN2; PIK3CA; PTK2; PIK3CB; PIK3C3; MAPK8; CAVI; CAPN1; ABL1; MAPK3; ITGA1; KRAS; RHOA; SRC; PIK3C2A; ITGB7; PPPICC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3;

Acute Phase Response Cellular Signaling disorders: Genes linked to these disorders: IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1;

PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; ILIR1; IL6;

PTEN Cellular Signaling disorders: Genes linked to these disorders: ITGAM; ITGA5; RAC1; PTEN; PRKCZ; BCL2L11; MAPK1; RAC2; AKT2; EGFR; IKBKB; CBL; PIK3CA; CDKNIB; PTK2; NFKB2; BCL2; PIK3CB; BCL2L1; MAPK3; ITGA1; KRAS; ITGB7; ILK; PDGFRB; INSR; RAF1; IKBKG; CASP9; CDKNIA; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOX01; CASP3;

p53 Cellular Signaling disorders: Genes linked to these disorders: RPS6KB1 PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS 1; ATR; BCL2L1; E2F1; PMAIP1; CHEK2; TNFASF10B; TP73; RB1; HDAC9; CDK2; PIK3C2A; MAPK14; TP53; LRDD; CDKNIA; HIPK2; AKT1; PIK3R1; RAM2B; APAF1; CTNNB1; SIRT1; CCND1; PRKDC; ATM; SFN; CDKN2A; JUN; SNAI2; GSK3B; BAX; AKT3;

Aryl Hydrocarbon Receptor Cellular Signaling disorders: Genes linked to these disorders: HSPB1; EP300; FASN; TGM2; RXRA; MAPK1; NQO1; NCOR2; SP1; ARNT; CDKNIB; FOS; CHEK1; SMARCA4; NFKB2; MAPK8; ALDHIA1; ATR; E2F1; MAPK3; NRIP1; CHEK2; RELA; TP73; GSTP1; RB1; SRC; CDK2; AHR; NFE2L2; NCOA3; TP53; TNF; CDKNIA; NCOA2; APAF1; NFKB1; CCND1; ATM; ESR1; CDKN2A; MYC; JUN; ESR2; BAX; IL6; CYP1B1; HSP90AA1;

Xenobiotic Metabolism Cellular Signaling disorders: Genes linked to these disorders: PRKCE; EP300; PRKCZ; RXRA; MAPK1; NQO1; NCOR2; PIK3CA; ARNT; PRKCI; NFKB2; CAMK2A; PIK3CB; PPP2RIA; PIK3C3; MAPK8; PRKD1; ALDHIA1; MAPK3; NRIP1; KRAS; MAPK13; PRKCD; GSTP1; MAPK9; NOS2A; ABCB1; AHR; PPP2CA; FTL; NFE2L2; PIK3C2A; PPARGCIA; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1;

SAPL/JNK Cellular Signaling disorders: Genes linked to these disorders: PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRKIA; MAP2K2; PIK3R1; MAP2K1; PAK3; CDC42; JUN; TTK; CSNK1A1; CRKL; BRAF; SGK;

PPAr/RXR Cellular Signaling disorders: Genes linked to these disorders: PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IASI; MAPK3; KRAS; RELA; PRKAA1; PPARGCIA; NCOA3; MAPK14; INSR; RAF1; IKBKG; RELB; MAP3K7; CREBBP; MAP2K2; JAK2; CHUK; MAP2K1; NFKB1; TGF-BAI; SMAD4; JUN; ILIR1; PRKCA; IL6; HSP90AA1; ADIPOO;

NF-KB Cellular Signaling disorders: Genes linked to these disorders: IRAK1; EIF2AK2; EP300; INS; MYD88; PRKCZ: TRAF6; TBK1; AKT2; EGFR;

IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4: PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; ILIR1;

Neuregulin Cellular Signaling disorders: Genes linked to these disorders: ERBB4; PRKCE; ITGAM; ITGA5: PTEN; PRKCZ; ELK1; MAPK1; PTPN11; AKT2; EGFR; ERBB2; PRKCI; CDKNIB; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HS P90AA1; RPS6KB1;

Wnt and Beta catenin Cellular Signaling disorders: Genes linked to these disorders: CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2: ILK; LEF1; SOX9; TP53; MAP3K7; CREBBP; TCF7L2; AKT1; PPP2R5C; WNT5A; LAPS; CTNNB1; TGFBR1; CCND1; GSK3A; DVL1; APC; CDKN2A; MYC; CSNK1A1; GSK3B; AKT3; SOX2;

Insulin Receptor Signaling disorders: Genes linked to these disorders: PTEN; INS; EIF4E; PTPN1; PRKCZ; MAPK1; TSC1; PTPN11; AKT2; CBL; PIK3CA; PRKCI; PIK3CB; PIK3C3; MAPK8; IASI; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1;

IL-6 Cellular Signaling disorders: Genes linked to these disorders: HSPB1; TRAF6; MAPKAPK2; ELK1; MAPK1; PTPN11; IKBKB; FOS; NFKB2: MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; ILIR1; SRF; IL6;

Hepatic Cholestasis Cellular Signaling disorders: Genes linked to these disorders: PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6;

IGF-1 Cellular Signaling disorders: Genes linked to these disorders: IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1;

NRF2-mediated Oxidative Stress Response Signaling disorders: Genes linked to these disorders: PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1;

Hepatic Fibrosis/Hepatic Stellate Cell Activation Signaling disorders: Genes linked to these disorders: EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; ILIR1; CCL2; HGF; MMP1; STAT1; IL6; CTGF; MMP9;

PPAR Signaling disorders: Genes linked to these disorders: EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; ILIR1; HSP9OAA1;

Fc Epsilon RI Signaling disorders: Genes linked to these disorders: PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA;

G-Protein Coupled Receptor Signaling disorders: Genes linked to these disorders: PRKCE; RAPIA; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; S TAT3; MAP2K1; NFKB1; BRAF; ATF4; AKT3; PRKCA;

Inositol Phosphate Metabolism Signaling disorders: Genes linked to these disorders: PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK;

PDGF Signaling disorders: Genes linked to these disorders: EIF2AK2; ELK1; ABL2; MAPK1; PIK3CA; FOS; PIK3CB; P IK3 C3; MAPK8; CAVI; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 VEGF Signaling disorders: Genes linked to these disorders: ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIFIA; NOS3; PIK3C2A; PXN; RAF1; MAP2K2; ELAVL1; AKT1; PIK3R1; MAP2K1; SFN; VEGFA; AKT3; FOXO1; PRKCA;

Natural Killer Cell Signaling disorders: Genes linked to these disorders: PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA;

Cell Cycle: GI/S Checkpoint Regulation Signaling disorders: Genes linked to these disorders: HDAC4; SMAD3; SUV39H1; HDAC5; CDKNIB; BTRC; ATR; ABL1; E2F1; HDAC2; HDAC7A; RB1; HDAC11; HDAC9; CDK2; E2F2; HDAC3; TP53; CDKNIA; CCND1; E2F4; ATM; RBL2; SMAD4; CDKN2A; MYC; NRG1; GSK3B; RBL1; HDAC6;

T Cell Receptor Signaling disorders: Genes linked to these disorders: RAC1; ELK1; MAPK1; IKBKB; CBL; PIK3CA; FOS; NFKB2; PIK3CB; PIK3C3; MAPK8; MAPK3; KRAS; RELA, PIK3C2A; BTK; LCK; RAF1; IKBKG; RELB, FYN; MAP2K2; PIK3R1; CHUK; MAP2K1; NFKB1; ITK; BCL10; JUN; VAV3;

Death Receptor disorders: Genes linked to these disorders: CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB, CASP9; CHUK; APAF1; NFKB1; CASP2; BIRC2; CASP3; BIRC3;

FGF Cell Signaling disorders: Genes linked to these disorders: RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF;

GM-CSF Cell Signaling disorders: Genes linked to these disorders: LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1;

Amyotrophic Lateral Sclerosis Cell Signaling disorders: Genes linked to these disorders: BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1;

JAK/Stat Cell Signaling disorders: Genes linked to these disorders: PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1;

Nicotinate and Nicotinamide Metabolism Cell Signaling disorders: Genes linked to these disorders: PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK;

Chemokine Cell Signaling disorders: Genes linked to these disorders: CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA;

IL-2 Cell Signaling disorders: Genes linked to these disorders: ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3;

Synaptic Long Term Depression Signaling disorders: Genes linked to these disorders: PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA;

Estrogen Receptor Cell Signaling disorders: Genes linked to these disorders: TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2;

Protein Ubiquitination Pathway Cell Signaling disorders: Genes linked to these disorders: TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3;

IL-10 Cell Signaling disorders: Genes linked to these disorders: TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; ILIR1; IL6;

VDR/RXR Activation Signaling disorders: Genes linked to these disorders: PRKCE; EP300; PRKCZ; RXRA; GADD45A; HES1; NCOR2; SP1; PRKCI; CDKNIB; PRKD1; PRKCD; RUNX2; KLF4; YY1; NCOA3; CDKN1A; NCOA2; SPP1; LAPS; CEBPB; FOXO1; PRKCA;

TGF-beta Cell Signaling disorders: Genes linked to these disorders: EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5;

Toll-like Receptor Cell Signaling disorders: Genes linked to these disorders: IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN;

p38 MAPK Cell Signaling disorders: Genes linked to these disorders: HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; ILIR1; SRF; STAT1; and Neurolrophin/TRK Cell Signaling disorders: Genes linked to these disorders: NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4.

Other cellular dysfunction disorders linked to a genetic modification are contemplated herein for example, FXR/RXR Activation, Synaptic Long Term Potentiation, Calcium Signaling EGF Signaling, Hypoxia Signaling in the Cardiovascular System, LPS/IL-1 Mediated Inhibition of RXR Function LXR/RXR Activation, Amyloid Processing, IL-4 Signaling, Cell Cycle: G2/M DNA Damage Checkpoint Regulation, Nitric Oxide Signaling in the Cardiovascular System Purine Metabolism, cAMP-mediated Signaling, Mitochondrial Dysfunction Notch Signaling Endoplasmic Reticulum Stress Pathway Pyrimidine Metabolism, Parkinson's Signaling Cardiac & Beta Adrenergic Signaling Glycolysis/Gluconeogenesis Interferon Signaling Sonic Hedgehog Signaling Glycerophospholipid Metabolism, Phospholipid Degradation, Tryptophan Metabolism Lysine Degradation Nucleotide Excision Repair Pathway, Starch and Sucrose Metabolism, Aminosugars Metabolism Arachidonic Acid Metabolism, Circadian Rhythm Signaling, Coagulation System Dopamine Receptor Signaling, Glutathione Metabolism Glycerolipid Metabolism Linoleic Acid Metabolism Methionine Metabolism Pyruvate Metabolism Arginine and Praline Metabolism, Eicosanoid Signaling Fructose and Mannose Metabolism, Galactose Metabolism Stilbene, Coumarine and Lignin Biosynthesis Antigen Presentation Pathway, Biosynthesis of Steroids Butanoate Metabolism Citrate Cycle Fatty Acid Metabolism Glycerophospholipid Metabolism, Histidine Metabolism Inositol Metabolism Metabolism of Xenobiotics by Cytochrome p450, Methane Metabolism, Phenylalanine Metabolism, Propanoate Metabolism Selenoamino Acid Metabolism Sphingolipid Metabolism Aminophosphonate Metabolism, Androgen and Estrogen Metabolism Ascorbate and Aldarate Metabolism, Bile Acid Biosynthesis Cysteine Metabolism Fatty Acid Biosynthesis Glutamate Receptor Signaling, NRF2-mediated, Oxidative Stress Response Pentose Phosphate Pathway, Pentose and Glucuronate Interconversions, Retinol Metabolism Riboflavin Metabolism Tyrosine Metabolism Ubiquinone Biosynthesis Valine, Leucine and Isoleucine Degradation Glycine, Serine and Threonine Metabolism Lysine Degradation Pain/Taste, or Mitochondrial Function Developmental Neurology or combinations thereof.

Nucleic acid-guided nucleases can encompass a native sequence, an engineered sequence, or engineered nucleotide sequences of synthetized variants. Non-limiting examples of types of engineering that can be done to obtain a non-naturally occurring nuclease system are as follows. Engineering can include codon optimization to facilitate expression or improve expression in a host cell, such as a heterologous host cell. Engineering can reduce the size or molecular weight of the nuclease in order to facilitate expression or delivery. Engineering can alter PAM selection in order to change PAM specificity or to broaden the range of recognized PAMs. Engineering can alter, increase, or decrease stability, processivity, specificity, or efficiency of a targetable nuclease system. Engineering can alter, increase, or decrease protein stability. Engineering can alter, increase, or decrease processivity of nucleic acid scanning. Engineering can alter, increase, or decrease target sequence specificity. Engineering can alter, increase, or decrease nuclease activity. Engineering can alter, increase, or decrease editing efficiency. Engineering can alter, increase, or decrease transformation efficiency. Engineering can alter, increase, or decrease nuclease or guide nucleic acid expression. As used herein, a non-naturally occurring nucleic acid sequence can be an engineered sequence or engineered nucleotide sequences of synthetized variants. Such non-naturally occurring nucleic acid sequences can be amplified, cloned, assembled, synthesized, generated from synthesized oligonucleotides or dNTPs, or otherwise obtained using methods known by those skilled in the art. In certain embodiments, examples of non-naturally occurring nucleic acid-guided nucleases disclosed herein can include those nucleic acid-guided nuclease with engineered polypeptide sequences (e.g., SEQ ID NO: 143-177, 229, 257-262, and 330, in some cases also comprising additional amino acid sequences, as described herein); engineered polynucleotide sequences that code therefore (e.g., SEQ ID NO: 1-142, 225-228, 230-256, and 230; in some cases also comprising additional nucleotide sequences, as described herein); one or more polynucleotides comprising RNA, e.g., engineered gRNA, compatible with those nucleic acid-guided nucleases, with nucleotide sequences, or portions of nucleotide sequences, of synthetized variants, or portions thereof (e.g., SEQ ID NO: 178-188, sequences as provided in Table 3 or portions thereof); and/or others as described herein.

Disclosed herein are nucleic acid-guided nucleases. It is understood that the disclosed nucleic acid-guided nuclease are functional in vitro, or in prokaryotic, archaeal, or eukaryotic cells for in vitro, in vivo, or ex vivo applications. Suitable nucleic acid-guided nucleases can be from an organism from a genus which includes but is not limited to *Thiomicrospira, Succinivibrio, Candidatus, Porphyromonas, Acidaminococcus, Acidomonococcus, Barnesiella, Prevotella, Smithella, Moraxella, Synergistes, Francisella, Leptospira, Catenibacterium, Kandleria, Clostridium, Dorea, Coprococcus, Enterococcus, Fructobacillus, Weissella, Pediococcus, Collinsella, Corynebacter, Sutterella, Legionella, Treponema, Roseburia, Filifactor,* Lachnospiraceae, *Eubacterium, Sedimentisphaera, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Parabacteroides, Staphylococcus, Nitratifractor, Mycoplasma, Alicyclobacillus, Brevibacilus, Bacillus, Bacteroidetes, Brevibacilus, Carnobacterium, Clostridiaridium, Clostridium, Desulfonatronum, Desulfovibrio, Helcococcus, Leptotrichia, Listeria, Methanomethyophilus, Methylobacterium,* Opitutaceae, *Paludibacter, Rhodobacter, Sphaerochaeta, Tuberibacillus, Oleiphilus,* Omnitrophica, Parcubacteria, and *Campylobacter.* Species of organism of such a genus can be as otherwise herein discussed. Suitable gRNAs can be from an organism from a genus or unclassified genus within a kingdom which includes but is not limited to Firmicute, Actinobacteria, *Bacteroidetes,* Proteobacteria, *Spirochates,* and *Tenericutes.* Suitable gRNAs can be from an organism from a genus or unclassified genus within a phylum which includes but is not limited to Erysipelotrichia, Clostridia, Bacilli, Actinobacteria, *Bacteroidetes, Catenovulum, Coprococcus,* Flavobacteria, Alphaproteobacteria, Betaproteobacteria, Gammaproteobacteria, Deltaproteobacteria, Epsilonproteobacteria, Spirochaetes, and Mollicutes. Suitable gRNAs can be from an organism from a genus or unclassified genus within an order which includes but is not limited to Clostridiales, *Lactobacillus,* Actinomycetales, Bacteroidales, Flavobacteriales, Rhizobiales, Rhodospirillales, Burkholderiales, Neisseriales, Legionellales, Nautiliales, Campylobacterales, Spirochaetales, Mycoplasmatales, and Thiotrichales. Suitable gRNAs can be from an organism from a genus or unclassified genus within a family which includes but is not limited to, Lachnospiraceae, Enterococcaceae, Leuconostocaceae, Lactobacillococcaceae, Peptostreptococcaceae, Staphylococcaceae, Eubacteriaceae, Corynebacterineae, Bacteroidaceae, *Flavobacterium,* Cryomoorphaceae, Rhodobiaceae, Rhodospirillaceae, Acetobacteraceae, Sutterellaceae, Neisseriaceae, Legionellaceae, Nautiliaceae, Campylobacteraceae, Spirochaetaceae, Mycoplasmataceae, Pisciririckettsiaceae, and Francisellaceae. In some embodiments, suitable gRNAs can be from an organism from a genus or unclassified genus within a family which includes *Acidaminococcus, Sedimentisphaera, Barnesiella* sp., *Bacteroidetes, Parabacteroides,* Lachnospiraceae, *Coprococcus* sp., *Catenovulum* sp., and *Collinsella.* Other nucleic acid-guided nucleases have been described in US Patent Application Publication No. US20160208243 filed Dec. 18, 2015, US Application Publication No. US20140068797 filed Mar. 15, 2013, U.S. Pat. No. 8,697,359 filed Oct. 15, 2013, and Zetsche et al., Cell 2015 Oct. 22; 163 (3): 759-71.

Some nucleic acid-guided nucleases suitable for use in the methods, systems, and compositions of the present disclosure can include, but are not limited to, those derived from an organism such as, but not limited to, *Thiomicrospira* sp.

XS5, *Eubacterium rectale, Succinivibrio dextrinosolvens, Candidatus Methanoplasma termitum, Candidatus* Methanomethylophilus alvus, *Porphyromonas crevioricanis, Flavobacterium branchiophilum, Acidaminococcus* Sp., *Acidomonococcus* sp., Lachnospiraceae bacterium COE1, *Prevotella brevis* ATCC 19188, *Smithella* sp. SCADC, *Moraxella bovoculi, Synergistes jonesii, Bacteroidetes* oral taxon 274, *Francisella tularensis, Leptospira* inadai serovar Lyme str. 10, *Acidomonococcus* sp. crystal structure (5B43) *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus, Butyrivibrio proteoclasticus* B316, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus Methanoplasma termitum, Eubacterium eligens, Moraxella bovoculi* 237, *Leptospira inadai*, Lachnospiraceae bacterium ND2006, *Porphyromonas crevioricanis* 3, *Prevotella disiens, Porphyromonas macacae, Catenibacterium* sp. CAG: 290, *Kandleria vitulina*, Clostridiales bacterium KA00274, Lachnospiraceae bacterium 3-2, Dorea longicatena, *Coprococcus catus* GD/7, *Enterococcus columbae* DSM 7374, *Fructobacillus* sp. EFB-N1, *Weissella halotolerans, Pediococcus acidilactici, Lactobacillus curvatus, Streptococcus* pyogenes, *Lactobacillus versmoldensis, Filifactor* alocis ATCC 35896, *Alicyclobacillus acidoterrestris, Alicyclobacillus acidoterrestris* ATCC 49025, *Desulfovibrio inopinatus, Desulfovibrio inopinatus* DSM 10711, *Oleiphilus* sp. *Oleiphilus* sp. HI0009, Candidtus kefeldibacteria, Parcubacteria CasY.4, Omnitrophica WOR 2 bacterium GWF2, *Bacillus* sp. NSP2.1, *Bacillus thermoamylovorans, Catenovulum* sp. CCB-QB4, *Coprococcus* sp. AF16-5, Lachnospiraceae bacterium MC2017, *Collinsella tanakaei, Parabacteroides distasonis, Bacteroidetes* bacterium HGW-*Bacteroidetes*-6, *Barnesiella* sp. An22, *Sedimentisphaera cyanobacteriorum*, and *Acidaminococcus massiliensis*.

In some embodiments, a nucleic acid-guided nuclease disclosed herein includes a polypeptide having an amino acid sequence of at least 50% identity to any one of SEQ ID NO: 143-177 and 229. In some embodiments, a nucleic acid-guided nuclease disclosed herein includes a polypeptide having an amino acid sequence of at least 60%, 65%, 75%, 85%, 95%, 99% or 100% identity to amino acid sequences of one or more of SEQ ID NO: 143-177 and 229. In some embodiments, a nucleic acid-guided nuclease disclosed herein includes a polypeptide having an amino acid sequence of at least 60%, 65%, 75%, 85%, 95%, 99% or 100% identity to amino acid sequences of one or more of SEQ ID NO: 143-151. In some embodiments, a nucleic acid-guided nuclease disclosed herein includes an amino acid sequence having at least 85%, 90%, 95%, 99% or 100%, amino acid identity to any one of SEQ ID NO: 143, 144, 147, 148, 150, and 151. In some embodiments, a nucleic acid-guided nuclease disclosed herein includes a polypeptide having at least 85%, 90%, 95%, 99% or 100% amino acid identity to an amino acid sequence represented by SEQ ID NO: 144.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by any one of SEQ ID NO: 143-177 and 229. In certain embodiments, a nucleic acid-guided nuclease, such as an engineered nucleic acid-guided nuclease, comprises an amino acid sequence that has at least 60% sequence identity to an amino acid sequence represented by any one of SEQ ID NO: 143-177 and 229. In certain embodiments, a nucleic acid-guided nuclease, such as an engineered nucleic acid-guided nuclease, comprises an amino acid sequence that has at least 80% sequence identity to an amino acid sequence represented by any one of SEQ ID NO: 143-177 and 229. In certain embodiments, a nucleic acid-guided nuclease, such as an engineered nucleic acid-guided nuclease, comprises an amino acid sequence that has at least 90% sequence identity to an amino acid sequence represented by any one of SEQ ID NO: 143-177 and 229. In certain embodiments, a nucleic acid-guided nuclease, such as an engineered nucleic acid-guided nuclease, comprises an amino acid sequence that has at least 95% sequence identity to an amino acid sequence represented by any one of SEQ ID NO: 143-177 and 229. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 143-177 and 229. These amino acid sequences may be the entire amino acid sequence of the nuclease polypeptide, or they may be an original nuclease polypeptide to which additional amino acid sequences are appended, as described above.

In certain embodiments, nucleases disclosed herein do not share conserved peptide motifs, or for polynucleotides coding for a nuclease, a nucleotide sequence coding for such a motif, with known nucleases. In certain embodiments, nucleases disclosed herein do not contain the peptide motif YLFQIYNKDF (SEQ ID NO. 224). In certain embodiments, one or more polynucleotides coding for a nuclease disclosed herein do not encode the peptide motif YLFQIYNKDF (SEQ ID NO. 224) within the encoded nuclease. The motif of SEQ ID NO: 224 may be completely absent, or may have one, two, three, four, five, or more than 5 substituted amino acids compared to SEQ ID NO: 224. The subsitutions may be conservative or radical, or any combination thereof. In certain embodiments, the non-SEQ ID NO: 224 sequence may have at least one radical substitution. In certain embodiments, the non-SEQ ID NO: 224 sequence may have at least one, two, three, or four substitutions that have a value of at least 10, 15, 20, or 25 on Sneath's index. In certain embodiments, the non-SEQ ID NO: 224 sequence may have at least one substitution that has a value of at least 25 on Sneath's index.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by any one of SEQ ID NO: 143-151, 161-163, 165, 166, 169, 171-175, 177, and 229. In certain embodiments, a nucleic acid-guided nuclease, such as an engineered nucleic acid-guided nuclease, comprises an amino acid sequence that has at least 60% sequence identity to an amino acid sequence represented by any one of SEQ ID NO: 143-151, 161-163, 165, 166, 169, 171-175, 177, and 229. In certain embodiments, a nucleic acid-guided nuclease, such as an engineered nucleic acid-guided nuclease, comprises an amino acid sequence that has at least 80% sequence identity to an amino acid sequence represented by any one of SEQ ID NO: 143-151, 161-163, 165, 166, 169, 171-175, 177, and 229. In certain embodiments, a nucleic acid-guided nuclease, such as an engineered nucleic acid-guided nuclease, comprises an amino acid sequence that has at least 90% sequence identity to an amino acid sequence represented by any one of SEQ ID NO: 143-151, 161-163, 165, 166, 169, 171-175,177, and 229. In certain embodiments, a nucleic acid-guided nuclease, such as an engineered nucleic acid-guided nuclease, comprises an amino acid sequence that has at least 95% sequence identity to an amino acid sequence represented by any one SEQ ID NO: 143-151, 161-163, 165, 166, 169, 171-175, 177, and 229. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 143-151, 161-163, 165, 166, 169, 171-175, 177, and 229. These amino acid sequences may be the entire amino acid sequence of the nuclease polypeptide, or they may be an original nuclease polypeptide to which additional amino acid sequences are appended, as described above.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by any one of SEQ ID NO: 149, 151, 175, and 177. In certain embodiments, a nucleic acid-guided nuclease, such as an engineered nucleic acid-guided nuclease, comprises an amino acid sequence that has at least 60% sequence identity to an amino acid sequence represented by any one of SEQ ID NO: 149, 151, 175, and 177. In certain embodiments, a nucleic acid-guided nuclease, such as an engineered nucleic acid-guided nuclease, comprises an amino acid sequence that has at least 80% sequence identity to an amino acid sequence represented by any one of SEQ ID NO: 149, 151, 175, and 177. In certain embodiments, a nucleic acid-guided nuclease, such as an engineered nucleic acid-guided nuclease, comprises an amino acid sequence that has at least 90% sequence identity to an amino acid sequence represented by any one of SEQ ID NO: SEQ ID NO: 149, 151, 175, and 177. In certain embodiments, a nucleic acid-guided nuclease, such as an engineered nucleic acid-guided nuclease, comprises an amino acid sequence that has at least 95% sequence identity to an amino acid sequence represented by any one SEQ ID NO: 149, 151, 175, and 177. In certain embodiments, a nucleic acid-guided nuclease, such as an engineered nucleic acid-guided nuclease, comprises an amino acid sequence that has 100% sequence identity to an amino acid sequence represented by any one of SEQ ID NO: SEQ ID NO: 149, 151, 175, and 177. These amino acid sequences may be the entire amino acid sequence of the nuclease polypeptide, or they may be an original nuclease polypeptide to which additional amino acid sequences are appended, as described above.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by any one of SEQ ID NO: 144, 153, and 229.

In certain embodiments, a nucleic acid-guided nuclease, such as an engineered nucleic acid-guided nuclease, comprises an amino acid sequence that has at least 60% sequence identity to an amino acid sequence represented by any one of SEQ ID NO: 144, 153, and 229. In certain embodiments, a nucleic acid-guided nuclease, such as an engineered nucleic acid-guided nuclease, comprises an amino acid sequence that has at least 80% sequence identity to an amino acid sequence represented by any one of SEQ ID NO: 144, 153, and 229. In certain embodiments, a nucleic acid-guided nuclease, such as an engineered nucleic acid-guided nuclease, comprises an amino acid sequence that has at least 90% sequence identity to an amino acid sequence represented by any one SEQ ID NO: 144, 153, and 229. In certain embodiments, a nucleic acid-guided nuclease, such as an engineered nucleic acid-guided nuclease, comprises an amino acid sequence that has at least 95% sequence identity to an amino acid sequence represented by any one SEQ ID NO: 144, 153, and 229. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 144, 153, and 229. These amino acid sequences may be the entire amino acid sequence of the nuclease polypeptide, or they may be an original nuclease polypeptide to which additional amino acid sequences are appended, as described above.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by SEQ ID NO: 144. In certain embodiments, a nucleic acid-guided nuclease, such as an engineered nucleic acid-guided nuclease, comprises an amino acid sequence that has at least 60% sequence identity to an amino acid sequence represented by SEQ ID NO: 144. In certain embodiments, a nucleic acid-guided nuclease, such as an engineered nucleic acid-guided nuclease, comprises an amino acid sequence that has at least 80% sequence identity to an amino acid sequence represented by SEQ ID NO: 144. In certain embodiments, a nucleic acid-guided nuclease, such as an engineered nucleic acid-guided nuclease, comprises an amino acid sequence that has at least 90% sequence identity to an amino acid sequence represented by SEQ ID NO: 144. In certain embodiments, a nucleic acid-guided nuclease, such as an engineered nucleic acid-guided nuclease, comprises an amino acid sequence that has at least 95% sequence identity to an amino acid sequence represented by SEQ ID NO: 144. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 144. These amino acid sequences may be the entire amino acid sequence of the nuclease polypeptide, or they may be an original nuclease polypeptide to which additional amino acid sequences are appended, as described above.

In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by SEQ ID NO: 153. In certain embodiments, a nucleic acid-guided nuclease, such as an engineered nucleic acid-guided nuclease, comprises an amino acid sequence that has at least 60% sequence identity to an amino acid sequence represented by SEQ ID NO: 153. In certain embodiments, a nucleic acid-guided nuclease, such as an engineered nucleic acid-guided nuclease, comprises an amino acid sequence that has at least 80% sequence identity to an amino acid sequence represented by SEQ ID NO: 153. In certain embodiments, a nucleic acid-guided nuclease, such as an engineered nucleic acid-guided nuclease, comprises an amino acid sequence that has at least 90% sequence identity to an amino acid sequence represented by SEQ ID NO: 153. In certain embodiments, a nucleic acid-guided nuclease, such as an engineered nucleic acid-guided nuclease, comprises an amino acid sequence that has at least 95% sequence identity to an amino acid sequence represented by SEQ ID NO: 153. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 153. These amino acid sequences may be the entire amino acid sequence of the nuclease polypeptide, or they may be an original nuclease polypeptide to which additional amino acid sequences are appended, as described above.

A nucleic acid-guided nuclease may comprise an amino acid sequence that, even without additional amino acid sequences, such as those described herein, is an engineered sequence, that is, that does not match any known native sequence. In certain embodiments herein, a nucleic acid-guided nuclease, such as an engineered nucleic acid-guided nuclease, comprises an amino acid sequence that has at least 60%, 65%, 75%, 85%, 90%, 95%, 99% or 100% sequence identity, for example at least 85%, in some cases at least 90%, in some cases at least 95%, in some cases at least 99% or even 100% sequence identity to an amino acid sequence represented by SEQ ID NO: 229. In certain embodiments, a nucleic acid-guided nuclease, such as an engineered nucleic acid-guided nuclease, comprises an amino acid sequence that has at least 60% sequence identity to an amino acid sequence represented by SEQ ID NO: 229. In certain embodiments, a nucleic acid-guided nuclease, such as an engineered nucleic acid-guided nuclease, comprises an amino acid sequence that has at least 80% sequence identity to an amino acid sequence represented by SEQ ID NO: 229. In certain embodiments, a nucleic acid-guided nuclease, such as an engineered nucleic acid-guided nuclease, comprises an amino acid sequence that has at least 90% sequence identity to an amino acid sequence represented by SEQ ID NO: 229. In certain embodiments, a nucleic acid-guided nuclease, such as an engineered nucleic acid-guided nuclease, comprises an amino acid sequence that has at least 95% sequence identity to an amino acid sequence represented by SEQ ID NO: 229. In certain embodiments, a nucleic acid-guided nuclease, such as an engineered nucleic acid-guided nuclease, comprises an amino acid sequence that has 100% sequence identity to an amino acid sequence represented by any one of SEQ ID NO: 229. These amino acid sequences may be the entire amino acid sequence of the nuclease polypeptide, or they may be an original nuclease polypeptide to which additional amino acid sequences are appended, as described above.

Thus, disclosed herein are compositions and methods providing and/or utilizing engineered nucleic acid-guided nuclease systems, components and products thereof, and other compositions and methods, as will be apparent. As used herein, an "engineered nucleic acid-guided nuclease system," also referred to herein as novel engineered nucleic acid-guided nuclease constructs, non-naturally occurring nucleic acid guided-nuclease systems, and the like, can refer to a nucleic acid-guided nuclease system, where the system is non-naturally occurring. The system can include a) one or more components that are in their final form, that is, as used in one or more methods, e.g., as used in a host cell, sometimes after further processing at one or more locations; b) a polynucleotide or polynucleotides coding for one or more components; the system can include a) and b). The components comprises one or more of: 1) an engineered nucleic-acid guided nuclease, or portion thereof, such as an active portion thereof, 2) an engineered guide nucleic acid, e.g., gRNA, compatible with the engineered nucleic acid-guided nuclease or portion thereof, and/or, in the case of coding or other polynucleotides, 3) one or more engineered polynucleotides. The system can further include other components, such as an editing template.

As used herein, "engineer, engineered," also referred to herein as novel, and the like, can refer to a non-naturally occurring composition or method.

In certain embodiments, examples of non-naturally occurring nucleic acid-guided nucleases disclosed herein can include those nucleic acid-guided nucleases produced with polynucleotide sequences, e.g. engineered polynucleotide sequences (e.g., SEQ ID NO: 1-142, 225-228, and 330, or a subgroup thereof, as described more fully herein) and those gNA, e.g., gRNA sequences of synthetized variants (e.g., SEQ ID NO: 178-188). In certain embodiments, a synthesized variant comprising a gNA, e.g. gRNA as shown in Table 3 and described more fully herein may be used.

In certain embodiments, provided herein are engineered nucleic acid-guided nucleases. As used herein, an "engineered nucleic acid-guided nuclease," or similar term, is a non-naturally occurring nucleic acid-guided nuclease; the nuclease can be non-naturally occurring for any reason including comprising an engineered nuclease polypeptide and/or one or more engineered polynucleotides coding therefore.

As used herein, a "nucleic acid-guided nuclease," also referred to herein simply as a nuclease, a CRISPR associated (Cas) nuclease, Cas12a-like, and the like, can refer to a nuclease that, together with a compatible guide nucleic acid, e.g., a compatible gRNA, can bind to and cleave at or near a target sequence in a target polynucleotide. A "target sequence," also referred to herein as a target nucleic acid, target polynucleotide sequence, and the like, can refer to a sequence to which a guide sequence has complementarity, where hybridization between a target sequence and a guide sequence that allows the activity of a nuclease complex, e.g., an engineered nuclease complex. A target polynucleotide of a targetable nuclease complex can be any polynucleotide endogenous or exogenous to the host cell. A "target polynucleotide," as that term and the like is used herein, can refer to a polynucleotide in which a target sequence is located.

Disclosed herein are guide nucleic acids (gNAs), e.g., gRNAs and polynucleotides encoding a gNA or gRNA, or part of a gNA or gRNA. In certain embodiments, a gNA, e.g., gRNA, is an engineered gNA, e.g., an engineered gRNA.

As used herein, "guide nucleic acid" or "guide polynucleotide" (gNA) can refer to one or more polynucleotides; a gNA includes 1) a guide sequence capable of hybridizing to a target sequence and 2) a scaffold sequence capable of interacting with or complexing with a nucleic acid-guided nuclease. A gNA, e.g., gRNA, is necessary to be complexed with a compatible nucleic acid-guided nuclease for the nuclease complex to locate and cleave at or near a target sequence. A "guide RNA (gRNA)," also referred to herein as an RNA guide polynucleotide, is a gNA whose nucleotides are ribonucleotides, either natural or modified.

A target polynucleotide of a targetable nuclease complex can be any polynucleotide endogenous or exogenous to the host cell. A "target polynucleotide," as that term and the like is used herein, can refer to a polynucleotide in which a target sequence is located. Target polynucleotides may comprise coding or non-coding nucleotides. In certain embodiments, a target sequence is within a target polynucleotide that is a Safe Harbor Site (SHS).

A guide nucleic acid can be provided as one or more nucleic acids.

In specific embodiments, a guide nucleic acid, e.g. gRNA, is provided as two separate polynucleotides that associate to form a functional guide nucleic acid, e.g., gRNA (split or dual guide nucleic acid, e.g., split or dual gRNA). In certain embodiments, a nucleic acid-guided nuclease, such as an engineered nucleic acid-guided nuclease as disclosed herein, is combined with a compatible gNA, e.g., compatible gRNA, that comprises a split gNA, e.g., split gRNA, where the nuclease, or nuclease sequence from which it was derived, does not, in its native state, combine with a split gNA, e.g., split gRNA, but rather combines with single gNA, e.g. single gRNA. In at least some of these native nucleases, e.g., Cas12a, a tracrRNA is absent in the native gRNA. In certain embodiments herein, a gRNA, such as a split gRNA, comprises a tracrRNA. See PCT Publication WO2021067788 for further discussion of these non-naturally occurring gNAs.

In specific embodiments, the guide sequence and the scaffold sequence are provided as a single polynucleotide (single guide nucleic acid, e.g., single gRNA).

A nucleic acid-guided nuclease, such as an engineered nucleic acid-guided nuclease as disclosed herein, when combined with a compatible gNA, e.g., compatible gRNA, forms a targetable nuclease complex, also referred to herein as a ribonucleoprotein (RNP) if gRNA, complexed nucleic acid-guided nuclease, or the like which is capable of binding to a target sequence within a target polynucleotide, as determined by the guide sequence of the guide nucleic acid, and cleaving at or near the target sequence. A guide polynucleotide can be DNA. A guide polynucleotide can be RNA. A guide polynucleotide can include both DNA and RNA. A guide polynucleotide can include modified or non-naturally occurring nucleotides. In cases where the guide polynucleotide comprises RNA, the RNA guide polynucleotide can be encoded by a DNA sequence on a polynucleotide molecule such as a plasmid, linear construct, or editing cassette as disclosed herein.

In general, a guide polynucleotide can complex with a compatible nucleic acid-guided nuclease and can hybridize with a target sequence, thereby directing the nuclease to the target sequence. A subject nucleic acid-guided nuclease capable of complexing with a guide polynucleotide can be referred to as a nucleic acid-guided nuclease that is compatible with the guide polynucleotide. In addition, a guide polynucleotide capable of complexing with a nucleic acid-guided nuclease can be referred to as a guide polynucleotide or a guide nucleic acid that is compatible with the nucleic acid-guided nucleases.

A gNA, e.g., gRNA can be a naturally-occurring gNA, e.g., naturally-occurring gRNA. In certain embodiments, a gNA, e.g., gRNA is an engineered gNA, e.g., an engineered gRNA. An "engineered guide nucleic acid," e.g., "engineered gRNA," also referred to as novel guide nucleic acid, e.g., novel gRNA, as that term is used herein, can include a non-naturally occurring guide nucleic acid, e.g. a non-naturally occurring gRNA, or an orthogonal gNA, e.g., an orthogonal gRNA.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occurring.

Orthogonal guide nucleic acids that are compatible with a nucleic acid-guided nuclease can comprise one or more common features. Common features can include sequence outside a pseudoknot region. Common features can include a pseudoknot region. Common features can include a primary sequence or secondary structure.

Disclosed herein are targetable nucleic acid-guided nuclease complexes. A "targetable nucleic acid guided nuclease complex," or the like, as that term is used herein, can refer to a nucleic acid-guided nuclease bound to a compatible gNA; the complex is functional to bind to and produce at least one strand break at or near a target sequence in a target polynucleotide. In certain embodiments, a targetable nucleic acid-guided complex comprises a gNA that is a gRNA; such complexes can be referred to as a "ribonucleoprotein," or "RNP." In certain embodiments, a targetable nucleic acid-guided nuclease complex, e.g., RNP, is an engineered targetable nucleic acid-guided nuclease complex, e.g., an engineered RNP. An "engineered targetable nucleic acid-guided nuclease complex," e.g., an "engineered RNP," or the like, as those terms are used herein, can refer to a targetable nucleic acid-guided nuclease complex, e.g., RNP, in which the nucleic acid-guided nuclease comprises an engineered nucleic acid-guided nuclease, the guide nucleic acid, e.g., gRNA comprises an engineered guide nucleic acid, e.g., engineered gRNA, or both. In certain embodiments, both the nuclease and the gNA, e.g., gRNA, are engineered. In embodiments in which an engineered nucleic acid-guided nuclease is used, any suitable nucleic acid-guided nuclease may be used, such as a nucleic acid-guided nuclease as disclosed herein. In embodiments in which an engineered gNA, e.g., engineered gRNA, is used, any suitable engineered gNA, e.g., engineered gRNA, may be used, such as an engineered gNA, e.g., engineered gRNA as disclosed herein.

A targetable nucleic acid-guided nuclease complex, e.g., RNP, may be produced in any suitable manner, as known in the art. At one extreme, both the nucleic acid-guided nuclease and its compatible gNA, e.g. gRNA, are produced synthetically, then combined to form a targetable nucleic acid-guided nuclease complex, e.g., RNP. The complex may be introduced into a host cell by any suitable method, e.g., electroporation. At the other extreme, a targetable nucleic acid-guided nuclease complex, e.g., RNP, is produced in a host cell by transcription and/or translation of one or more polynucleotides introduced into the host cell, where the polynucleotide(s) contain portions coding for the one or more components of the targetable nucleic acid-guided nuclease complex, e.g., RNP, such as one or more portions coding for the nuclease, one or more portions coding for one or more gNAs, e.g., gRNAs, and one or more portions coding for one or more editing templates, if used. Regulatory elements and others may be added to render the polynucleotides operable, as discussed herein and known in the art, to produce one or more vectors. The one or more vectors are introduced into the host cell by any suitable method. The various components are produced by the cell and assemble into a targetable nucleic acid-guided nuclease complex, e.g., RNP, inside the cell. Either of these, or any variation between these two extremes, may be used, and have been extensively described in the art; see, e.g., U.S. Pat. No. 10,337,028. In certain embodiments, a targetable nucleic acid-guided nuclease is produced in a first host cell by introduction of a suitable polynucleotide or polynucleotides, packaged in one or more suitable vectors, into the first host cell which produces the nuclease, then extraction and purification to a suitable degree. It will be apparent that various purification tags, cleavage sequences, FLAG and 3XFLAG, as described herein, are useful to help isolate and purify the nuclease. In certain embodiments, one or more compatible gNAs, e.g., one or more compatible gRNAs, such as one or more compatible gRNAs comprising one or more modified nucleotides, e.g., one or more chemically modified nucleotides, which can be a split gNA, e.g., split gRNA or single gNA, e.g., single gRNA (in certain embodiments a split gNA), are synthesized as complete gNAs, or gRNAs. The synthesized gNAs, e.g., gRNA can be introduced into the host cell, where, when a compatible gNA, e.g., compatible gRNA, encounters a nuclease they bind into a targetable nucleic acid-guided nuclease complex, e.g., RNP. The synthesized gNAs, e.g., gRNA can be contacted with a suitable nuclease outside the cell for a time sufficient to allow formation of a targetable nucleic acid-guided nuclease complex, e.g., RNP, which is then introduced into a host cell.

In certain embodiments, a sequence to be integrated comprises a transgene.

In certain embodiments, compositions and methods disclosed herein utilize a nucleic acid-guided nuclease that comprises an engineered nuclease polypeptide. As used herein, the term "engineered nuclease polypeptide," also referred to herein as an engineered sequence, and the like, can refer to a nuclease polypeptide comprising a non-naturally occurring amino acid sequence, where the polypeptide functions as a nucleic acid-guided nuclease, either as is or with additional processing, in combination with a compatible gNA, e.g., gRNA. A non-naturally occurring amino acid sequence can be, e.g., an amino acid sequence that differs from a native sequence, e.g., through substitution of one or more amino acids in the sequence, and/or non-natural amino acids in the sequence, through addition of one or more amino acids at the N-terminus, the C-terminus, or a combination thereof.

As used herein, an "engineered nucleic acid-guided nuclease," also referred to herein as Cas 12a-like nuclease, is a non-naturally occurring nuclease; the nuclease can be non-naturally occurring for reasons including, but not limited to, comprising an engineered nuclease polypeptide.

In certain embodiments, an engineered nuclease polypeptide can include nuclease polypeptide, e.g., a nuclease polypeptide comprising an amino sequence with at least 60%, 65%, 75%, 85%, 90%, 95%, 99% or 100% sequence identity, for example at least 85%, in some cases at least 90%, in some cases at least 95%, in some cases at least 99% or even 100% sequence identity to any one amino acid sequence represented by SEQ ID NOs: 143-177 and 229, to which additional amino acids have been added, e.g., at the amino terminus, the carboxy terminus, or both. Such additions can include any suitable addition; exemplary additions include one or more nuclear localization sequences (NLSs), one or more purification tags, one or more cleavage sequences, one or more markers, one or more FLAG or 3×FLAG sequences, or a combination thereof, wherein each addition can occur at the amino terminus or carboxy terminus of the core amino acid sequence, as desired or appropriate. "At the amino terminus," as that term is used herein, includes amino acid additions that are added before, and directly or indirectly connected to, the amino terminus "At the amino terminus," as that term is used herein, includes amino acid additions that are added after, and directly or indirectly connected to, the amino terminus. One or more of the additional amino acids may be cleaved during preparation and/or processing of the nuclease polypeptide.

A "nuclease polypeptide," and the like, as that term is used herein, can refer to a polypeptide having an amino acid sequence such that the polypeptide functions as a nucleic acid-guided nuclease, either as is or with additional processing, in combination with a compatible gNA, e.g., compatible gRNA. A "native nuclease polypeptide," also referred to herein as a native nuclease polypeptide sequence, and the like, as that term is used herein, can refer to a nuclease polypeptide that is found in nature, e.g., in a nucleic acid-guided nuclease found in a prokaryotic organism.

As used herein, the term "original nuclease polynucleotide," and the like, can refer to a nuclease polypeptide from which an engineered nuclease polypeptide is derived. In some cases an original nuclease polypeptide can be a native nuclease polypeptide.

As used herein, the term "engineered nuclease polypeptide," also referred to herein as an engineered sequence, and the like, can refer to a nuclease polypeptide that is non-naturally occurring. The nuclease polypeptide can be non-naturally occurring for any reason, including having an amino acid sequence that differs from known native nuclease polypeptides, or having a nuclease polypeptide that comprises an original nuclease polypeptide (which can be a native nuclease polypeptide) to which one or more additional amino acid sequences are appended, at the N-terminus, at the C-terminus, or both.

Additional amino acids sequences that can be appended to an original nuclease polypeptide can be any suitable amino acid sequence; in certain embodiments, additional amino acid sequences include one or more of a nuclear localization sequence (NLS), one or more of a purification tag, one or more of a cleavage sequence, one or more of a FLAG or 3XFLAG, and/or one or more of a marker. When more than one of a type of amino acid sequence is used, e.g., more than one NLS, each amino acid sequence can be the same as, or different from the others, and each can be added at the N-terminus or the C-terminus of the original nuclease polypeptide. In certain embodiments, the order and/or type of additional amino acid sequences can be a specific order and/or type. The order is read as N-terminal to C-terminal. NLS In certain embodiments, an additional amino acid sequence can include one or more nuclear localization sequences (NLSs), such as 1, 2, 3, 4, 5, 6, 7, 8, 9, 10, or more NLSs, that may be added to the original nuclease polypeptide. In some embodiments, the engineered nuclease polypeptide comprises 1, 2, 3, 4, 5, 6, 7, 8, 9, 10, or more NLSs at the amino-terminus of the original nuclease polypeptide, 1, 2, 3, 4, 5, 6, 7, 8, 9, 10, or more NLSs at the carboxy-terminus of the original nuclease polypeptide, or a combination of these (e.g. one or more NLS at the amino-terminus and one or more NLS at the carboxy terminus). In certain embodiments, the engineered nuclease polypeptide comprises 1-3, in some cases 1-2, for example, 1, NLS at the amino terminus. In certain embodiments, the engineered nuclease polypeptide comprises 3-5, in some cases 3-4, for example, 3, NLS at the carboxy terminus. When more than one NLS is present, each may be selected independently of the others, such that a single NLS may be present in more than one copy and/or in combination with one or more other NLSs present in one or more copies. In certain embodiments, 4 NLS are appended to the original nuclease polypeptide; in certain of these embodiments, 1 NLS is at the N-terminus and 3 are at the C-terminus. In certain embodiments, an engineered nuclease polypeptide provided herein comprises at least one myc-related NLS comprising the sequence PAAKKKKLD (SEQ ID NO:279) or an amino acid sequence having at least 50, 60, 70, 75, 80, 85, 90, 95, or 98% sequence identity therewith; in certain embodiments the myc-related NLS is at the N-terminus of the original nuclease polypeptide. In certain embodiments, an engineered nuclease polypeptide provided herein comprisesat least one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith; in certain embodiments the nucleoplasmin NLS is at the C-terminus. In certain embodiments an engineered nuclease polypeptide provided herein comprises at least one, or at least two, SV40 NLS sequences comprising the sequence PKKKRKV (SEQ ID NO:263) or an amino acid sequence having at least 50, 60, 70, 75, 80, 85, 90, 95, or 98% sequence identity therewith; in certain embodiments the SV40 NLSs are at the C-terminus. In certain embodiments, an engineered nuclease polypeptide provided herein comprises1 NLS at the N-terminus and 3 NLSs at the C-terminus, for example 1 myc-related NLS at the N-terminus and one nucleoplasmin NLS and two SV40 NLSs at the C-terminus. In certain embodiments, an engineered nuclease polypeptide provided herein comprises 1 myc-related NLS at the N-terminus with the sequence PAAKKKKLD (SEQ ID NO:279 or an amino acid sequence having at least 50, 60, 70, 75, 80, 85, 90, 95, or 98% sequence identity therewith, and one nucleoplasmin NLS comprising the sequence KRPAATKKAGQAKKKK (SEQ ID NO: 264) or an amino acid sequence having at least 50, 60, 70, 75, 80, 85, 90, 95, or 98% sequence identity therewith, and two SV40 NLSs comprising the sequence PKKKRKV (SEQ ID NO: 263) or an amino acid sequence having at least 50, 60, 70, 75, 80, 85, 90, 95, or 98% sequence identity therewith, at the C-terminus. Generally, the one or more NLS will be adjacent to the original nuclease polypeptide, either on the N-side of it, or the C-side, or both. E.g., in embodiments with 4 NLS the order can be NLS-original nuclease polypeptide-NLS-NLS-NLS. Thus, if part or all of other tags are removed, e.g., by cleavage at a cleavage sequence, the remaining portion of the engineered nuclease polypeptide will retain the NLSs.

Non-limiting examples of NLSs include an NLS sequence derived from: the NLS of the SV40 virus large T-antigen, having the amino acid sequence PKKKRKV (SEQ ID NO:263), or an amino acid sequence having at least 50, 60, 70, 75, 80, 85, 90, 95, or 98% sequence identity therewith; the NLS from nucleoplasmin (e.g. the nucleoplasmin bipartite NLS with the sequence KRPAATKKAGQAKKKK (SEQ ID NO:264) or an amino acid sequence having at least 50, 60, 70, 75, 80, 85, 90, 95, or 98% sequence identity therewith; the c-myc NLS having the amino acid sequence PAAKRVKLD SEQ ID NO:265) or an amino acid sequence having at least 50, 60, 70, 75, 80, 85, 90, 95, or 98% sequence identity therewith or RQRRNELKRSP (SEQ ID NO:266) or an amino acid sequence having at least 50, 60, 70, 75, 80, 85, 90, 95, or 98% sequence identity therewith; the hRNPA1 M9 NLS having the sequence NQSSNFGPMKGGNFGGRSSGPYGGGGQYFAK-PRNQGGY (SEQ ID NO:267) or an amino acid sequence having at least 50, 60, 70, 75, 80, 85, 90, 95, or 98% sequence identity therewith; the sequence RMRIZFKNKGKDTAELRRRRVEVSVELRKAKKD-EQILKRRNV (SEQ ID NO: 268) or an amino acid sequence having at least 50, 60, 70, 75, 80, 85, 90, 95, or 98% sequence identity therewith, of the IBB domain from importin-alpha; the sequences VSRKRPRP (SEQ ID NO:269) or an amino acid sequence having at least 50, 60, 70, 75, 80, 85, 90, 95, or 98% sequence identity therewith, and PPK-KARED (SEQ ID NO:270) or an amino acid sequence having at least 50, 60, 70, 75, 80, 85, 90, 95, or 98% sequence identity therewith, of the myoma T protein; the sequence PQPKKKPL (SEQ ID NO:271) or an amino acid sequence having at least 50, 60, 70, 75, 80, 85, 90, 95, or 98% sequence identity therewith, of human p53; the sequence SALIKKKKKMAP (SEQ ID NO:272) or an amino acid sequence having at least 50, 60, 70, 75, 80, 85, 90, 95, or 98% sequence identity therewith, of mouse c-abl IV; the sequences DRLRR (SEQ ID NO:273) or an amino acid sequence having at least 50, 60, 70, 75, 80, 85, 90, 95, or 98% sequence identity therewith, and PKQKKRK (SEQ ID NO:274) or an amino acid sequence having at least 50, 60, 70, 75, 80, 85, 90, 95, or 98% sequence identity therewith, of the influenza virus NS1; the sequence RKLKKKIKKL (SEQ ID NO:275) or an amino acid sequence having at least 50, 60, 70, 75, 80, 85, 90, 95, or 98% sequence identity therewith, of the Hepatitis virus delta antigen; the sequence REKKKFLKRR (SEQ ID NO:276) or an amino acid sequence having at least 50, 60, 70, 75, 80, 85, 90, 95, or 98% sequence identity therewith, of the mouse Mx1 protein; the sequence KRKGDEVDGVDEVAKKK-SKK (SEQ ID NO:277) or an amino acid sequence having at least 50, 60, 70, 75, 80, 85, 90, 95, or 98% sequence identity therewith, of the human poly(ADP-ribose) polymerase; and the sequence RKCLQAGMNLEARKTKK (SEQ ID NO:278) or an amino acid sequence having at least 50, 60, 70, 75, 80, 85, 90, 95, or 98% sequence identity therewith, of the steroid hormone receptors (human) glucocorticoid. In certain embodiments, an engineered nuclease polypeptide disclosed herein comprises an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequences of one or more of SEQ ID NO: 143-177 or 229 and at least one myc-related NLS comprising the sequence PAAKKKKLD (SEQ ID NO:279) or an amino acid sequence having at least 50, 60, 70, 75, 80, 85, 90, 95, or 98% sequence identity therewith; in certain embodiments the myc-related NLS is at the N-terminus. Additionally or alternatively, the engineered nuclease polypeptide can include at least one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith; in certain embodiments the nucleoplasmin NLS is at the C-terminus. Additionally or alternatively the engineered nuclease polypeptide can include at least one, or at least two, for example one, in certain embodiments two, SV40 NLS sequences comprising the sequence PKKKRKV (SEQ ID NO: 263) or an amino acid sequence having at least 50, 60, 70, 75, 80, 85, 90, 95, or 98% sequence identity therewith; in certain embodiments the SV40 NLSs are at the C-terminus. In certain embodiments, an engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to an amino acid sequences any one of SEQ ID NO: 143-177 or 229 and one NLS at the N-terminus and three NLSs at the C-terminus, for example 1 myc-related NLS as described above at the N-terminus and one nucleoplasmin NLS as described above and two SV40 NLSs as described above at the C-terminus. In certain embodiments, an engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to any one of SEQ ID NO: 143-177 or 229 and one myc-related NLS at the N-terminus with the sequence PAAKKKKLD (SEQ ID NO:279) or an amino acid sequence having at least 50, 60, 70, 75, 80, 85, 90, 95, or 98% sequence identity therewith; and one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith, and two SV40 NLSs comprising the sequence PKKKRKV (SEQ ID NO:263) or an amino acid sequence having at least 50, 60, 70, 75, 80, 85, 90, 95, or 98% sequence identity therewith at the C-terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of any of SEQ ID NO: 144, 153, and 229, (in some cases SEQ ID NO: 144; in some cases SEQ ID NO: 153; in some cases SEQ ID NO: 229); and at least one myc-related NLS comprising the sequence PAAKKKKLD (SEQ ID NO:279) or an amino acid sequence having at least 50, 60, 70, 75, 80, 85, 90, 95, or 98% sequence identity therewith; in certain embodiments the myc-related NLS is at the N-. Additionally or alternatively, the engineered nuclease polypeptide can include at least one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith; in certain embodiments the nucleoplasmin NLS is at the C-terminus. Additionally or alternatively the engineered nuclease polypeptide can include at least one, or at least two, for example one, in certain embodiments two, SV40 NLS sequences comprising the sequence PKKKRKV (SEQ ID NO: 263) or an amino acid sequence having at least 50, 60, 70, 75, 80, 85, 90, 95, or 98% sequence identity therewith; in certain embodiments the SV40 NLSs are at the C-terminus. In certain embodiments, a engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of any of SEQ ID NO: 144, 153, and 229 (in some cases SEQ ID NO: 144; in some cases SEQ ID NO: 153; in some cases SEQ ID NO: 229); and one NLS at the N-terminus and three NLSs at the C-terminus, for example 1 myc-related NLS as described above at the N-terminus and one nucleoplasmin NLS as described above and two SV40 NLSs as described above at the C-terminus. In certain embodiments, an engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of any of SEQ ID NO: 144, 153, and 229, (in some cases SEQ ID NO: 144; in some cases SEQ ID NO: 153; in some cases SEQ ID NO: 229); and one myc-related NLS at the N-terminus with the sequence PAAKKKKLD (SEQ ID NO:279) or an amino acid sequence having at least 50, 60, 70, 75, 80, 85, 90, 95, or 98% sequence identity therewith; and one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith, and two SV40 NLSs comprising the sequence PKKKRKV (SEQ ID NO:263) or an amino acid sequence having at least 50, 60, 70, 75, 80, 85, 90, 95, or 98% sequence identity therewith at the C-terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153 and at least one myc-related NLS comprising the sequence PAAKKKKLD (SEQ ID NO:279) or an amino acid sequence having at least 50, 60, 70, 75, 80, 85, 90, 95, or 98% sequence identity therewith; in certain embodiments the myc-related NLS is at the N-terminus. Additionally or alternatively, the engineered nuclease polypeptide can include at least one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith; in certain embodiments the nucleoplasmin NLS is at the C-terminus. Additionally or alternatively the engineered nuclease polypeptide can include at least one, or at least two, for example one, in certain embodiments two, SV40 NLS sequences comprising the sequence PKKKRKV (SEQ ID NO: 263) or an amino acid sequence having at least 50, 60, 70, 75, 80, 85, 90, 95, or 98% sequence identity therewith; in certain embodiments the SV40 NLSs are at the C-terminus. In certain embodiments, a engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153 and one NLS at the N-terminus and three NLSs at the C-terminus, for example 1 myc-related NLS as described above at the N-terminus and one nucleoplasmin NLS as described above and two SV40 NLSs as described above at the C-terminus. In certain embodiments, an engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153, and one myc-related NLS at the N-terminus with the sequence PAAKKKKLD (SEQ ID NO:279) or an amino acid sequence having at least 50, 60, 70, 75, 80, 85, 90, 95, or 98% sequence identity therewith; and one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith, and two SV40 NLSs comprising the sequence PKKKRKV (SEQ ID NO:263) or an amino acid sequence having at least 50, 60, 70, 75, 80, 85, 90, 95, or 98% sequence identity therewith at the C-terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229 and at least one myc-related NLS comprising the sequence PAAKKKKLD (SEQ ID NO:279) or an amino acid sequence having at least 50, 60, 70, 75, 80, 85, 90, 95, or 98% sequence identity therewith; in certain embodiments the myc-related NLS is at the N-. Additionally or alternatively, the engineered nuclease polypeptide can include at least one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith; in certain embodiments the nucleoplasmin NLS is at the C-terminus. Additionally or alternatively the engineered nuclease polypeptide can include at least one, or at least two, for example one, in certain embodiments two, SV40 NLS sequences comprising the sequence PKKKRKV (SEQ ID NO: 263) or an amino acid sequence having at least 50, 60, 70, 75, 80, 85, 90, 95, or 98% sequence identity therewith; in certain embodiments the SV40 NLSs are at the C-terminus. In certain embodiments, a engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229 and one NLS at the N-terminus and three NLSs at the C-terminus, for example 1 myc-related NLS as described above at the N-terminus and one nucleoplasmin NLS as described above and two SV40 NLSs as described above at the C-terminus. In certain embodiments, an engineered nuclease polypeptide disclosed herein includes an original nuclease polypeptide having an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229. and one myc-related NLS at the N-terminus with the sequence PAAKKKKLD (SEQ ID NO:279) or an amino acid sequence having at least 50, 60, 70, 75, 80, 85, 90, 95, or 98% sequence identity therewith; and one nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith, and two SV40 NLSs comprising the sequence PKKKRKV (SEQ ID NO:263) or an amino acid sequence having at least 50, 60, 70, 75, 80, 85, 90, 95, or 98% sequence identity therewith at the C-terminus.

b) Purification Tags

In addition to, or alternatively to, including one or more NLSs, and/or other additional amino acid sequences described herein, an engineered nuclease polypeptide disclosed herein can include one or more purification tags, which can be at the N-terminus or the C-terminus of an original nuclease polypeptide. Any suitable purification tag or tags may be used. Exemplary purification tags include a poly-his tag, which can include a gly at its N-terminus, such as a Gly-6× His tag (SEQ ID NO: 332), or a Gly-8×His tag (SEQ ID NO: 333). Further exemplary purification tags include hemagglutinin (HA), c-myc, T7, and Glu-Glu; maltose binding protein (mbp); N-terminal glutathione S-transferase (GST); calmodulin binding peptide (CBP). In certain embodiments, in some cases in addition to one or more NLS as described above, an engineered nuclease polypeptide comprises a Gly-6× his tag, for example at the N-terminus. In certain embodiments, an engineered nuclease polypeptide comprises a Gly-8×his tag, for example at the N-terminus. Generally, if a Gly-polyhis tag is used, it is the most N-terminal sequence added.

In certain embodiments, an engineered nuclease polypeptide disclosed herein can comprise a poly-his tag, or a gly-polyhis tag such as a Gly-6×His tag or a Gly-8× His tag, e.g., at the N-terminus. These Gly-6×His or Gly-8× His tags are applied for several reasons including: 1) a 6×His or 8×His tag can be used in protein purification to allow binding to the chromatographic columns for purification, and 2) the N-terminal glycine allows further, site-specific, chemical modifications that permit advanced protein engineering. Further, the Gly-6×His or Gly-8×His is designed for easy removal, if desired, by digestion with Tobacco Etch Virus (TEV) protease. The Gly-6×His 6×His or Gly-8×His tag can be positioned on the N-terminus. Gly-6×His tags are further described in Martos-Maldonado et al., *Nat Commun.* (2018) 17; 9(1): 3307, the disclosure of which is incorporated herein.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to an amino acid sequence of any one of SEQ ID NO: 143-177 or 229, or to the amino acid sequence of any of SEQ ID NO: 144, 153, and 229, (in some cases SEQ ID NO: 144; in some cases SEQ ID NO: 153; in some cases SEQ ID NO: 229); and a Gly-poly-His tag at the N-terminus, such as a Gly-6× His tag (SEQ ID NO: 332) or a Gly-8×His tag (SEQ ID NO: 333) In certain embodiments, the tag is a Gly-6×His tag (SEQ ID NO: 332). In certain embodiments, the tag is a Gly-8×His tag (SEQ ID NO: 333). Additionally or alternatively, the engineered nuclease polypeptide can include a FLAG (SEQ ID NO: 281) or 3XFLAG (SEQ ID NO: 280), at either the carboxy or the amino terminus. In certain embodiments the tag is a 3XFLAG (SEQ ID NO: 280) at the amino terminus; if a Gly-polyHis tag is also present, the 3XFLAG can be internal to the Gly-polyHis tag. In certain embodiments the tag is a 3XFLAG (SEQ ID NO: 280) at the carboxy terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of any of SEQ ID NO: 144, 153, and 229, (in some cases SEQ ID NO: 144; in some cases SEQ ID NO: 153; in some cases SEQ ID NO: 229); and a Gly-poly-His tag at the N-terminus, such as a Gly-6× His tag (SEQ ID NO: 332) or a Gly-8×His tag (SEQ ID NO: 333) In certain embodiments, the tag is a Gly-6×His tag (SEQ ID NO: 332). In certain embodiments, the tag is a Gly-8×His tag (SEQ ID NO: 333). Additionally or alternatively, the engineered nuclease polypeptide can include a FLAG (SEQ ID NO: 281) or 3XFLAG (SEQ ID NO: 280), at either the carboxy or the amino terminus. In certain embodiments the tag is a 3XFLAG (SEQ ID NO:

280) at the amino terminus; if a Gly-polyHis tag is also present, the 3XFLAG can be internal to the Gly-polyHis tag. In certain embodiments the tag is a 3XFLAG (SEQ ID NO: 280) at the carboxy terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153 and a Gly-poly-His tag at the N-terminus, such as a Gly-6× His tag (SEQ ID NO: 332) or a Gly-8×His tag (SEQ ID NO: 333) In certain embodiments, the tag is a Gly-6×His tag (SEQ ID NO: 332). In certain embodiments, the tag is a Gly-8×His tag (SEQ ID NO: 333). Additionally or alternatively, the engineered nuclease polypeptide can include a FLAG (SEQ ID NO: 281) or 3XFLAG (SEQ ID NO: 280), at either the carboxy or the amino terminus. In certain embodiments the tag is a 3XFLAG (SEQ ID NO: 280) at the amino terminus; if a Gly-polyHis tag is also present, the 3XFLAG can be internal to the Gly-polyHis tag. In certain embodiments the tag is a 3XFLAG (SEQ ID NO: 280) at the carboxy terminus.

In certain embodiments, an engineered nuclease polypeptide disclosed herein comprises an original nuclease polypeptide of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229 and a Gly-poly-His tag at the N-terminus, such as a Gly-6× His tag (SEQ ID NO: 332) or a Gly-8×His tag (SEQ ID NO: 333) In certain embodiments, the tag is a Gly-6×His tag (SEQ ID NO: 332). In certain embodiments, the tag is a Gly-8×His tag (SEQ ID NO: 333).

FLAG or 3xFLAG

Additionally or alternatively, the engineered nuclease polypeptide can include a FLAG (SEQ ID NO: 281) or 3XFLAG (SEQ ID NO: 280), at either the carboxy or the amino terminus. In certain embodiments the tag is a 3XFLAG (SEQ ID NO: 280) at the amino terminus; if a Gly-polyHis tag is also present, the 3XFLAG can be internal to the Gly-polyHis tag. In certain embodiments the tag is a 3XFLAG (SEQ ID NO: 280) at the carboxy terminus.

Cleavage Sequences

In addition to, or alternatively to, including one or more NLSs, purification tags, and/or other additional amino acid sequences described herein, an engineered nuclease polypeptide disclosed herein can include one or more cleavage sequences, which can be at the N-terminus or the C-terminus. Any suitable cleavage sequence can be used; if a plurality of cleavage sequences is used, they may be the same or different. In certain embodiments a cleavage sequence comprises a Tobacco Etch Virus protease cleavage sequence, herein referred to as a "TEV sequence" (SEQ ID NO: 331). The TEV sequence can be at the amino terminus. Generally, the cleavage sequence, e.g., TEV sequence, is located so that cleavage at the cleavage sequence leaves other additional amino acid sequences, in particular any NLS added to the original nuclease polypeptide, intact.

Combinations

Disclosed herein are engineered nuclease polypeptides that comprise more than one additional amino acid sequence is added to an original nuclease polypeptide. In addition to such engineered nuclease polynucleotides disclosed above, additional engineered nuclease polynucleotides can include:

In certain embodiments, an engineered nuclease polypeptide, or active portion thereof, disclosed herein comprises components comprising
    (i) a purification tag;
    (ii) a cleavage site;
    (iii) an NLS;
    (iv) an original nuclease polypeptide; and
    (v) 3 NLSs;

In certain embodiments the engineered nuclease polypeptide further comprises, at the C-terminus (vi) 3XFLAG. In certain embodiments, the engineered polypeptide further comprises, at the N-terrminus, v(3x) FLAG. In certain embodiments the 3xFLAG at the N-terminus is between the purification tag and the cleavage site. In certain embodiments, the components are in order, i.e., in order from amino-terminus to carboxy terminus of the nuclease polypeptide. In certain embodiments, the purification tag comprises a Gly-polyhis tag, such as a Gly-6×His or Gly-8×His tag; in certain embodiments the purification tag comprises a Gly-6×His tag. In certain embodiments the cleavage site comprises TEV. In certain embodiments, the N-terminal NLS comprises a myc-related NLS, such as the c-myc NLS having the amino acid sequence PAAKRVKLD SEQ ID NO:265) or an amino acid sequence having at least 50, 60, 70, 75, 80, 85, 90, 95, or 98% sequence identity therewith or RQRRNELKRSP (SEQ ID NO:266) or an amino acid sequence having at least 50, 60, 70, 75, 80, 85, 90, 95, or 98% sequence identity therewith. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequences of any one of SEQ ID NO: 143-177 and 229, or to the amino acid sequence of any of SEQ ID NO: 144, 153, and 229, (in some cases SEQ ID NO: 144; in some cases SEQ ID NO: 153; in some cases SEQ ID NO: 229). In certain embodiments, the original nuclease polypeptide does not contain the peptide motif of SEQ ID NO: 224. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequence of any one of SEQ ID NO: 143-151, 161-163, 165, 166, 169, 171-175, 177 or 229. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequence of any one of SEQ ID NO: 149, 151, 175, or 177. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 144, 153, or 229. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 144. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229. In certain embodiments, the 3 N-terminal NLSs comprise a nucleoplasmin NLS, such as nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith and two SV40 NLSs, such as two SV40 NLSs comprising the sequence PKKKRKV (SEQ ID NO: 263) or an amino acid sequence having at least 50, 60, 70, 75, 80, 85, 90, 95, or 98% sequence identity therewith at the C-terminus. In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 257. In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 260. In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 261. In certain embodiments, the engineered nuclease polynucleotide further comprises the 3×FLAG (SEQ ID NO: 280). In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 258.

In certain embodiments, an engineered nuclease polypeptide, or active portion thereof, disclosed herein comprises (i) a purification tag;

(ii) a cleavage site;

(iii) a NLS (iv) an original nuclease polypeptide (v) 3 NLS.

In certain embodiments the engineered nuclease polypeptide further comprises, at the C-terminus (vi) 3XFLAG. In certain embodiments, the engineered polypeptide further comprises, at the N-terminus, (vi) (3x) FLAG. In certain embodiments the 3xFLAG at the N-terminus is between the purification tag and the cleavage site. In certain embodiments, the components are in order, i.e., in order from amino-terminus to carboxy terminus of the nuclease polypeptide. In certain embodiments, the purification tag comprises a Gly-polyhis tag, such as a Gly-6×His or Gly-8×His tag; in certain embodiments the purification tag comprises a Gly-8×His tag. In certain embodiments the cleavage site comprises TEV. In certain embodiments, the N-terminal NLS comprises a myc-related NLS, such as the c-myc NLS having the amino acid sequence PAAKRVKLD SEQ ID NO:265) or an amino acid sequence having at least 50, 60, 70, 75, 80, 85, 90, 95, or 98% sequence identity therewith or RQRRNELKRSP (SEQ ID NO:266) or an amino acid sequence having at least 50, 60, 70, 75, 80, 85, 90, 95, or 98% sequence identity therewith. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequences of any one of SEQ ID NO: 143-177 and 229, or to the amino acid sequence of any of SEQ ID NO: 144, 153, and 229, (in some cases SEQ ID NO: 144; in some cases SEQ ID NO: 153; in some cases SEQ ID NO: 229). In certain embodiments, the original nuclease polypeptide does not contain the peptide motif of SEQ ID NO: 224. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequence of any one of SEQ ID NO: 143-151, 161-163, 165, 166, 169, 171-175, 177 or 229. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to amino acid sequence of any one of SEQ ID NO: 149, 151, 175, or 177. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 144, 153, or 229. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 144. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 153. In certain embodiments the original nuclease polypeptide has an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 229. In certain embodiments, the 3 N-terminal NLSs comprise a nucleoplasmin NLS, such as nucleoplasmin NLS comprising the sequence KRPAATKKAGQAKKKK (SEQ ID NO:264) or an amino acid sequence having at least 50, 60, 70, 75, 80, 85, 90, 95, or 98% sequence identity therewith and two SV40 NLSs, such as two SV40 NLSs comprising the sequence PKKKRKV (SEQ ID NO: 263) or an amino acid sequence having at least 50, 60, 70, 75, 80, 85, 90, 95, or 98% sequence identity therewith at the C-terminus. In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 259. In certain embodiments the engineered nuclease polypeptide comprises an amino acid sequence of at least 50, 60%, 65%, 75%, 85%, 95%, 99% or 100% identity, for example at least 60%, in some cases at least 85%, and in certain embodiments at least 95% identity, or even 100% identity, to the amino acid sequence of SEQ ID NO: 262.

A nucleic acid-guided nuclease may be encoded by one or more polynucleotides. The polynucleotide(s) can be natural. In certain embodiments, the polynucleotide(s) comprise an engineered polynucleotide. An engineered polynucleotide is a non-naturally occurring polynucleotide, e.g., a polynucleotide coding for an engineered nucleic acid-guided nuclease where the amino acid sequence coded for has been altered from the native sequence, either by one or more substitutions in a native nuclease polypeptide, addition of one or more amino acid sequences to the C- and/or N-terminus of the nuclease polypeptide, or both. An engineered polynucleotide can additionally or alternatively be produced by codon optimization, e.g., a polynucleotide native for one species is optimized for transcription and/or translation in another species, where at least 1, 2, 5, 10, 20, 50, 100, 200, or 500 codons in the polynucleotide differs between the two. An engineered polynucleotide coding for a nucleic acid-guided nuclease, such as a nucleic acid-guided nuclease disclosed herein, can be codon optimized for a prokaryotic organism, e.g., E. coli. An engineered polynucleotide coding for a nucleic acid-guided nuclease, such as a nucleic acid-guided nuclease disclosed herein, can be codon optimized for a single celled eukaryotic organism, e.g., a yeast, such as S. cerivisae. An engineered polynucleotide coding for a nucleic acid-guided nuclease, such as a nucleic acid-guided nuclease disclosed herein, can be codon optimized for a multicellular eukaryotic organism, e.g., a human.

Disclosed herein are polynucleotides coding for nucleic acid-guided nucleases provided herein. In certain embodiments, the polynucleotides are naturally-occurring. In certain embodiments, the polynucleotides are engineered, e.g., either because the nuclease polypeptide coded for comprises an engineered nuclease polypeptide, the polynucleotide has been codon optimized, or both.

In certain embodiments, provided are one or more polynucleotides coding for one or more of an amino acid sequence corresponding any one of SEQ ID NO: 143-177 and 229, or an amino acid sequence that is at least 50, 60, 70, 80, 90, 95, or 100% identical to one or more of an amino acid sequence corresponding any one of SEQ ID NO: 143-177 and 229. In certain of the embodiments, the encoded polypeptide does not contain the peptide motif YLFQIYNKDF (SEQ ID NO. 224). Thus, in certain embodiments, provided are polynucleotides coding for one or more of an amino acid sequence corresponding any one of SEQ ID NO: 143-151, 161-163, 165, 166, 169, 171-175, 177, and 229 or an amino acid sequence that is at least 50, 60, 70, 80, 90, 95, or 100% identical to the one or more of an amino acid sequence corresponding any one of SEQ ID NO: 143-151, 161-163, 165, 166, 169, 171-175, 177, and 229. In certain embodiments, the encoded polypeptide that does not contain the peptide motif YLFQIYNKDF (SEQ ID NO. 224) comprises at least one amino acid substitution that is a radical amino acid substitution, and/or that has a Sneath's index value of greater than 20. In certain embodiments, provided are polynucleotides coding for one or more of an amino acid sequence corresponding any one of SEQ ID NO: 149, 151, 175, and 177, or an amino acid sequence that is at least 50, 60, 70, 80, 90, 95, or 100% identical to the one or more of an amino acid sequence corresponding any one of any one of SEQ ID NO: 149, 151, 175, and 177. In certain embodiments, provided are polynucleotides coding for one or more of an amino acid sequence corresponding any one of SEQ ID NO: 144, 153, and 229, or an amino acid sequence that is at least 50, 60, 70, 80, 90, 95, or 100% identical to the one or more of an amino acid sequence corresponding any one of any one of SEQ ID NO: 144, 153, and 229. In certain embodiments, provided are polynucleotides coding for the amino acid sequence corresponding to SEQ ID NO: 144, or an amino acid sequence that is at least 50, 60, 70, 80, 90, 95, or 100% identical to the amino acid sequence corresponding to SEQ ID NO: 144. In certain embodiments, provided are polynucleotides coding for an amino acid sequence corresponding to SEQ ID NO: 153 or an amino acid sequence that is at least 50, 60, 70, 80, 90, 95, or 100% identical to amino acid sequence corresponding to SEQ ID NO: 153. In certain embodiments, provided are polynucleotides coding for an amino acid sequence corresponding to SEQ ID NO: 229 or an amino acid sequence that is at least 50, 60, 70, 80, 90, 95, or 100% identical to amino acid sequence corresponding to SEQ ID NO: 229. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. In certain of the latter embodiments, provided are polynucleotides coding for an amino acid sequence corresponding to SEQ ID NO: 257-262 or an amino acid sequence that is at least 50, 60, 70, 80, 90, 95, or 100% identical to amino acid sequence corresponding to SEQ ID NO: 257-262. In certain of the above embodiments the polynucleotides are engineered polynucleotides.

In certain embodiments, provided herein are one or more polynucleotides with a sequence corresponding to any one of SEQ ID NO: 1-142 and 225-228 or a polynucleotide sequence that is at least 50, 60, 70, 80, 90, 95, or 100% identical to one or more of a polynucleotide sequence corresponding any one of SEQ ID NO: 1-142 and 225-228. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. Sequences can be codon optimized, e.g., for one of E. coli, S. cerevisiae, or human codon optimized. In certain of the above embodiments the polynucleotides are engineered polynucleotides. In certain of the latter embodiments, the polynucleotide is codon optimized for E. coli, S. cerevisiae, or human.

In certain embodiments, provided herein are one or more polynucleotides with a sequence corresponding to any one of SEQ ID NO: 1, 5, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, and 225, or polynucleotide sequence that is at least 50, 60, 70, 80, 90, 95, or 100% identical to one or more of a polynucleotide sequence corresponding any one of SEQ ID NO: 1, 5, 11, 15, 19, 23, 27, 31, 35, 39, 43, 47, 51, 55, 59, 63, 67, 71, 75, 79, 83, 87, 91, 95, 99, 103, 107, 111, 115, 119, 123, 127, 131, 135, 139, and 225. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. Sequences can be codon optimized, e.g., for one of E. coli, S. cerevisiae, or human codon optimized. In certain embodiments a polynucleotide corresponding to any one of SEQ ID NO: 230-256, and 330, or polynucleotide sequence that is at least 50, 60, 70, 80, 90, 95, or 100% identical to one or more of a polynucleotide sequence corresponding any one of to any one of SEQ ID NO: 230-256, and 330 is provided. In certain of the above embodiments the polynucleotides are engineered polynucleotides. In certain of the latter embodiments, the polynucleotide is codon optimized for *E. coli, S. cerevisiae,* or human In some embodiments, a guide RNA (gRNA) disclosed herein can be any gRNA. In other embodiments, a gRNA disclosed herein can include a nucleic acid sequence of at least 50% nucleic acid identity to any one of SEQ ID NO: 178-188. In some embodiments, a gRNA disclosed herein includes a nucleic acid sequence having about 60%, 65%, 70%, 75%, 80%, 85%, 90%, 95%, greater than 95%, or 100% nucleic acid identity to any one of SEQ ID NO: 178-188. In some embodiments, a gRNA disclosed herein includes a nucleic acid sequence of at least 50%, 60%, 65%, 70%, 75%, 80%, 85%, 90%, 95%, greater than 95%, nucleic acid identity to any one of SEQ ID NO: 178-188. In some embodiments, the engineered polynucleotide (gRNA) can be split into fragments encompassing a synthetic tracrRNA and crRNA.

In some embodiments, gRNA disclosed herein includes a nucleic acid sequence of at least 50% nucleic acid identity to SEQ ID NO: 188. In some embodiments, a gRNA disclosed herein includes a nucleic acid sequence of about 10%, 20%, 30%, 40%, 50%, 60%, 65%, 70%, 75%, 80%, 85%, 90%, 95%, greater than 95%, or 100% nucleic acid identity to SEQ ID NO: 188 In some embodiments, a gRNA disclosed herein includes a nucleic acid sequence of at least 50%, 60%, 65%, 70%, 75%, 80%, 85%, 90%, 95%, greater than 95%, nucleic acid identity to SEQ ID NO: 188.

In some embodiments, polynucleotide encoding a nucleic acid-guided nuclease disclosed herein includes a nucleic acid sequence having at least 50% nucleic acid identity to any nucleic acid represented by SEQ ID NO: 1-142 or 225. In some embodiments, a nucleic acid-guided nuclease disclosed herein includes a nucleic acid sequence of about 60%, 65%, 70%, 75%, 80%, 85%, 90%, 95%, greater than 95%, or 100% polynucleotide identity to any one of SEQ ID NO: 1-142 or 225.

In some instances, a nucleic acid-guided nuclease disclosed herein is encoded from a nucleic acid sequence. Such a nucleic acid can be codon optimized for expression in a desired host cell. Suitable host cells can include, as non-limiting examples, prokaryotic cells such as *E. coli, P. aeruginosa, B. subtilus,* and *V. natriegens,* eukaryotic cells, such as *S. cerevisiae* plant cells, insect cells, nematode cells, amphibian cells, fish cells, or mammalian cells, including human cells.

A nucleic acid sequence encoding a nucleic acid-guided nuclease can be operably linked to a promoter. Such nucleic acid sequences can be linear or circular. The nucleic acid sequences can be encompasses on a larger linear or circular nucleic acid sequences that comprises additional elements such as an origin of replication, selectable or screenable marker, terminator, other components of a targetable nuclease system, such as a guide nucleic acid, or an editing or recorder cassette as disclosed herein. In some aspects, nucleic acid sequences can include a at least one glycine, at least one 6× histidine tag, and/or at least one 3× nuclear localization signal tag. Larger nucleic acid sequences can be recombinant expression vectors, as are described in more detail later.

In general, a guide polynucleotide can complex with a compatible nucleic acid-guided nuclease and can hybridize with a target sequence, thereby directing the nuclease to the target sequence. A subject nucleic acid-guided nuclease capable of complexing with a guide polynucleotide can be referred to as a nucleic acid-guided nuclease that is compatible with the guide polynucleotide. In addition, a guide polynucleotide capable of complexing with a nucleic acid-guided nuclease can be referred to as a guide polynucleotide or a guide nucleic acid that is compatible with the nucleic acid-guided nucleases. In some embodiments, a polynucleotide (gRNA) disclosed herein can be split into fragments encompassing a synthetic tracrRNA and crRNA. Examples of gRNA can include, but are not limited to, gRNAs represented in Table 1.

TABLE 1

| Exemplary gRNAs | |
| --- | --- |
| gRNA SEQ ID NO | gRNA Nucleotide Sequence |
| 178 | GUCUAAAAGACCAUAUGAAUU UCUACUUUCGUAGAUCUGAUG GUCCAUGUCUGUUA |
| 179 | GUCUAAAGGCCUUAUAAAAUU UCUACUGUCGUAGAUCUGAUG GUCCAUGUCUGUUA |
| 180 | GUCUAUACAGACACUUUAAUU CUACUAUUGUAGAUCUGAUGG UCCAUGUCUGUUA |
| 181 | GUCUGAAAGACAAGUAUAAUU UCUACUAUUGUAGAUCUGAUG GUCCAUGUCUGUUA |
| 182 | GGCUAUAAGCCUUGUAUAAUU UCUACUAUUGUAGAUCUGAUG GUCCAUGUCUGUUA |
| 183 | GUUGAAACUGUAAGCGGAAUG UCUACUUGGGUAGAUCUGAUG GUCCAUGUCUGUUA |
| 184 | GCAUGAGAACCAUGCAUUUCU AAGGUACUCCAAAACCUGAUG GUCCAUGUCUGUUA |
| 185 | GUUGAGUAACCUUAAAUAAUU UCUACUGUUGUAGAUCUGUGG UCCAUGUCUGUUA |
| 186 | AUCUACAACAGUAGAAAUUUA AGCUAAGGCUUAGACCUGAUG GUCCAUGUCUGUUA |
| 187 | UAAUUUCUACUCUUGUAGAUC UGAUGGUCCAUGUCUGUUA |
| 188 | UAAUUUCUACUCUUGUAGAUC UGAUGGUCCAUGUCUGUUA |

A guide polynucleotide can be DNA. A guide polynucleotide can be RNA. A guide polynucleotide can include both DNA and RNA. A guide polynucleotide can include modified or non-naturally occurring nucleotides. In cases where the guide polynucleotide comprises RNA, the RNA guide polynucleotide can be encoded by a DNA sequence on a polynucleotide molecule such as a plasmid, linear construct, or editing cassette as disclosed herein.

A guide polynucleotide can comprise a guide sequence. A guide sequence is a polynucleotide sequence having sufficient complementarity with a target polynucleotide sequence to hybridize with the target sequence and direct sequence-specific binding of a complexed nucleic acid-guided nuclease to the target sequence. The degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences. In some embodiments, a guide sequence can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In other embodiments, a guide sequence can be less than about 75, 50, 45, 40, 35, 30, 25, 20 nucleotides in length. Preferably the guide sequence is 10-30 nucleotides long. The guide sequence can be 15-20 nucleotides in length. The guide sequence can be 15 nucleotides in length. The guide sequence can be 16 nucleotides in length. The guide sequence can be 17 nucleotides in length. The guide sequence can be 18 nucleotides in length. The guide sequence can be 19 nucleotides in length. The guide sequence can be 20 nucleotides in length.

A guide polynucleotide can include a scaffold sequence. In general, a "scaffold sequence" can include any sequence that has sufficient sequence to promote formation of a targetable nuclease complex, wherein the targetable nuclease complex includes, but is not limited to, a nucleic acid-guided nuclease and a guide polynucleotide can include a scaffold sequence and a guide sequence. Sufficient sequence within the scaffold sequence to promote formation of a targetable nuclease complex may include a degree of complementarity along the length of two sequence regions within the scaffold sequence, such as one or two sequence regions involved in forming a secondary structure. In some cases, the one or two sequence regions are included or encoded on the same polynucleotide. In some cases, the one or two sequence regions are included or encoded on separate polynucleotides. Optimal alignment may be determined by any suitable alignment algorithm, and may further account for secondary structures, such as self-complementarity within either the one or two sequence regions. In some embodiments, the degree of complementarity between the one or two sequence regions along the length of the shorter of the two when optimally aligned is about or more than about 25%, 30%, 40%, 50%, 60%, 70%, 80%, 90%, 95%, 97.5%, 99%, or higher. In some embodiments, at least one of the two sequence regions can be about or more than about 5, 6, 7, 8, 9, 10, 11, 12, 13, 14, 15, 16, 17, 18, 19, 20, 25, 30, 40, 50, or more nucleotides in length.

A scaffold sequence of a subject guide polynucleotide can comprise a secondary structure. A secondary structure can comprise a pseudoknot region. In some cases, binding kinetics of a guide polynucleotide to a nucleic acid-guided nuclease is determined in part by secondary structures within the scaffold sequence. In some cases, binding kinetics of a guide polynucleotide to a nucleic acid-guided nuclease is determined in part by nucleic acid sequence with the scaffold sequence. In some aspects, the invention provides a nuclease that binds to a guide polynucleotide can include a conserved scaffold sequence. For example, the nucleic acid-guided nucleases for use in the present disclosure can bind to a conserved pseudoknot region. Thus, a scaffold sequence can comprise a secondary structure. A secondary structure can comprise a pseudoknot region. In some cases, binding kinetics of a guide polynucleotide to a nucleic acid-guided nuclease is determined in part by secondary structures within the scaffold sequence. In some cases, binding kinetics of a guide polynucleotide to a nucleic acid-guided nuclease is determined in part by nucleic acid sequence with the scaffold sequence.

In certain methods, a compatible scaffold sequence for a compatible guide nucleic acid can be found by scanning sequences adjacent to a native nucleic acid-guided nuclease loci. For example, native nucleic acid-guided nucleases can be encoded on a genome within proximity to a corresponding compatible guide nucleic acid or scaffold sequence. See, e.g., Example 3.

Conserved DNA sequences for each of ART1-ART35 are provided in Table 3 below; these sequences code for conserved sequences of gRNA for the respective nuclease, and RNA sequences can be created from these sequences (Conserved RNA sequences in Table 3); in addition, some or all of the RNA sequences may undergo further processing to remove one or more nucleotides from either end. For each specific ART nuclease, the length of the spacer is a specific number of NT and the length of the scaffold sequence is a specific number of NT; thus, in certain embodiments gRNA (before processing) for a specific nuclease these lengths are as shown in Table 3, and the total length of a gRNA (before potential additional processing to produce the final gRNA) for a specific ART nuclease is the total of the two. In discussing various embodiments herein, it is understood that ART nuclease and a gRNA comprising a conserved sequence (or portion thereof, see below) refers to a specific ART nuclease, as disclosed herein, and its corresponding specific gRNA, or portion thereof.

Thus, in addition, for each ART nuclease, the conserved RNA sequence may contain portions of the RNA sequences, e.g., RNA sequence that are shortened versions of the conserved RNA, such as sequences, e.g., shortened by one or more nucleotides on either or both of the 5' and/or 3' ends. Without being bound by theory, it is thought that these portions can, at least in some cases, correspond to, e.g., RNA sequences that represent the final gRNA after editing, and/or highly conserved sequences present in most or all gRNAs for use with a particular ART nuclease. In the latter case, these can be, for example, RNA sequences that are needed to produce important secondary structure in the final gRNA. A gRNA for a particular ART nuclease can comprise a conserved portion, or a highly conserved portion, e.g. a highly conserved portion that comprises a nucleotide sequence for secondary structure of the gRNA, e.g., a pseudoknot.

Thus, in certain embodiments, a conserved gRNA, that is, an gRNA comprising a conserved portion such as a conserved scaffold portion, or a portion thereof, for a particular ART nuclease is used with that ART nuclease. In certain embodiments, the conserved gRNA comprises any one of the sequences of SEQ ID NO: 291-325, or a portion thereof. The portion thereof is a continuous sequence within the conserved RNA sequence, where one or more nucleotides are removed, either on the 5' side, the 3' side, or both (in this context, "removed" simply means not present in the portion of the conserved RNA, no matter how it is produced). The portion can be any suitable portion; in certain embodiments, the portion comprises 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides removed from the 5' end of the gRNA; in certain embodiments, the portion comprises 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides removed from the 3' end of the gRNA, so long as at least one nucleotide is removed. In certain embodiments, a highly conserved portion is used, e.g., a highly conserved portion that comprises a nucleotide sequence for secondary structure of the gRNA, e.g., a secondary structure comprising a pseudoknot.

In certain embodiments, a gRNA for use with a particular ART nuclease is a split gRNA, such as a split gRNA comprising modified nucleotides; in certain embodiments, a gRNA for use with a particular ART nuclease is a single gRNA, such as a single gRNA comprising modified nucleotides. Suitable gNAs, e.g., gRNAs can be produced by any suitable method e.g., in a native setting, in a host cell, synthesized (gRNA with modified nucleotides), or by any other suitable method. Such methods are well-known in the art. In certain embodiments, a gRNA for use with a particular ART nuclease is produced by synthesis. In certain embodiments, a gRNA for use with a particular ART nuclease is produced by synthesis and contains modified nucleotides, such as chemically modified nucleotides. Synthesized gRNAs with modified nucleotides are described further in US Patent Application Publication No 20160289675. In certain embodiments, a gRNA for use with a particular nucleic acid-guided nuclease comprises a conserved gRNA or portion thereof, such as a conserved gRNA or portion thereof derived from one of SEQ ID NO:291-325, as described above; in certain embodiments, the conserved gRNA comprises a highly conserved portion; e.g., a portion that forms secondary structure, such as a pseudoknot. It is understood that "nucleotide" as used herein may be the native nucleotide or a modified nucleotide; for example, SEQ ID NO: 291-325 as written are to be interpreted as being either sequences comprising natural ribonucleotides, or sequences comprising one or more chemically modified ribonucleotides, depending on context.

TABLE 3

| Conserved DNA Sequences and corresponding RNA sequences | | | | | |
|---|---|---|---|---|---|
| Nuclease Designation | Organism of origin | Conserved DNA sequence | Spacr length | Scaff length | Conserved RNA sequence |
| ART1 | *Bacteroides plebeius* strain AF27-30, *Bacteroides plebeius* strain AF27-1 | GTCTATATGACAA AGTAATTTCTACTA TGTGTAGAT (SEQ ID NO: 189) | 28 | 36 | GUCUAUAUGACA AAGUAAUUUCUA CUAUGUGUAGAU (SEQ ID NO: 291) |
| ART2 | ART2: *Sulfurimonas* sp. SN118 | GTCTAAAGGTACC ACCAAATTTCTACT GTTGTAGAT (SEQ ID NO: 190) | 27 | 36 | GUCUAAAGGUAC CACCAAAUUUCU ACUGUUGUAGAU (SEQ ID NO: 292) |
| ART3 | *Prevotella ruminicola* strain BPI-162, strain BPI-34 | GGTATAAACCATA GTAAAATTTCTGCT ATTGCAGAT (SEQ ID NO: 191) | 29 | 36 | GGUAUAAACCAU AGUAAAAUUUCU GCUAUUGCAGAU (SEQ ID NO: 293) |
| ART4 | *Clostridium* sp. AM42-36 | GTTGAATAACCTTA AATAATTTCTACTG TTGTAGAT (SEQ ID NO: 192) | 27 | 36 | GUUGAAUAACCU UAAAUAAUUUCU ACUGUUGUAGAU (SEQ ID NO: 294) |
| ART5 | *Limihaloglobus sulfuriphilus* | CTCTAAGAGGCAT ATAAAATTTCTACT GTTGTA (SEQ ID NO: 193) | 29 | 33 | CUCUAAGAGGCA UAUAAAAUUUCU ACUGUUGUA (SEQ ID NO: 295) |
| ART6 | *Ruminococcus bromii* strain AF25-7LB | GTTTAATAACCCTA TATAATTTCTACTA TTGTAGAT (SEQ ID NO: 194) | 26 | 36 | GUUUAAUAACCC UAUAUAAUUUCU ACUAUUGUAGAU (SEQ ID NO: 296) |
| ART7 | *Prevotella* sp. P4-119 | GGCTATAATGCCTA AGTAATTTCTACTA TTGTAGAT (SEQ ID NO: 195) | 28 | 36 | GGCUAUAAUGCC UAAGUAAUUUCU ACUAUUGUAGAU (SEQ ID NO: 297) |
| ART8 | Parcubacteria group bacterium Gr01-1014_33 (aquifer metagenome) | GTTTAATACACCTA TAAGATTTCTACTT TTGTAGAT (SEQ ID NO: 196) | 26 | 36 | GUUUAAUACACC UAUAAGAUUUCU ACUUUUGUAGAU (SEQ ID NO: 298) |
| ART9 | *Prevotella* sp. P4-119 | GGCTATAATGCCTA AGTAATTTCTACTA TTGTAGAT (SEQ ID NO: 197) | 28 | 36 | GGCUAUAAUGCC UAAGUAAUUUCU ACUAUUGUAGAU (SEQ ID NO: 299) |
| ART10 | *Acinetobacter indicus* strain IHIT31231 | GGCTAACAGCCTTT TAAATTTCTACTGT GTGTAGAT (SEQ ID NO: 198) | 27 | 36 | GGCUAACAGCCU UUUAAAUUUCUA CUGUGUGUAGAU (SEQ ID NO: 300) |

TABLE 3-continued

| | | Conserved DNA Sequences and corresponding RNA sequences | | | |
|---|---|---|---|---|---|
| Nuclease Designation | Organism of origin | Conserved DNA sequence | Spacr length | Scaff length | Conserved RNA sequence |
| ART11 ART11* | ART11: Pseudo-butyrivibrio xylanivorans strain MA3014 ART11*: None | GCTTAGAACCTTTA AATAATTTCTACTA TTGTAGAT (SEQ ID NO: 199) | 26 | 36 | GCUUAGAACCUU UAAAUAAUUUCU ACUAUUGUAGAU (SEQ ID NO: 301) |
| ART12 | Prevotella sp. | GGCTAGTATGCTTC AATAATTTCTACTA TTGTAGAT (SEQ ID NO: 200) | 28 | 36 | GGCUAGUAUGCU UCAAUAAUUUCU ACUAUUGUAGAU (SEQ ID NO: 302) |
| ART13 | Prevotella copri | GGCTAGTATGCTTC AATAATTTCTACTA TTGTAGAT (SEQ ID NO: 201) | 28 | 36 | GGCUAGUAUGCU UCAAUAAUUUCU ACUAUUGUAGAU (SEQ ID NO: 303) |
| ART14 | Prevotella copri strain AF15-25 | GGCTAGTATGCTTC AATAATTTCTACTA TTGTAGAT (SEQ ID NO: 202) | 28 | 36 | GGCUAGUAUGCU UCAAUAAUUUCU ACUAUUGUAGAU (SEQ ID NO: 304) |
| ART15 | Moraxella bovoculi strain 58069 | GTCTAACGACCTTT TAAATTTCTACTGT TTGTAGAT (SEQ ID NO: 203) | 27 | 36 | GUCUAACGACCU UUUAAAUUUCUA CUGUUUGUAGAU (SEQ ID NO: 305) |
| ART16 | Moraxella lacunata strain NCTC7911 | GTCTAACGACCTTT TAAATTTCTACTGT TTGTAGAT (SEQ ID NO: 204) | 27 | 36 | GUCUAACGACCU UUUAAAUUUCUA CUGUUUGUAGAU (SEQ ID NO: 306) |
| ART17 | Moraxella lacunata NBRC 102154, Moraxella lacunata strain CCUG 4441 CCUG_4441T_ 0000062 | GTCTAACGACCTTT TAAATTTCTACTGT TTGTAGAT (SEQ ID NO: 205) | 27 | 36 | GUCUAACGACCU UUUAAAUUUCUA CUGUUUGUAGAU (SEQ ID NO: 307) |
| ART18 | Bacteroidales bacterium Oil-RF-744-WCA-WT-10 seq2, Muribaculaceae bacterium DSM 108610 strain Oil-RF-744-WCA-WT-10 | GGCTACATAAAGC CTATAATTTCTACT ATGTGTAGAT (SEQ ID NO: 206) | 28 | 37 | GGCUACAUAAAG CCUAUAAUUUCU ACUAUGUGUAGA U (SEQ ID NO: 308) |
| ART19 | Bacteroides plebeius strain AM49-7BH, strain OM08-14 | GTCTATATGACTAA GTAATTTCTACTAT GTGTAGAT (SEQ ID NO: 207) | 28 | 36 | GUCUAUAUGACU AAGUAAUUUCUA CUAUGUGUAGAU (SEQ ID NO: 309) |
| ART20 | Bacteroides plebeius strain AM23-23 | GTCTATATGACTAA GTAATTTCTACTAT GTGTAGAT (SEQ ID NO: 208) | 28 | 36 | GUCUAUAUGACU AAGUAAUUUCUA CUAUGUGUAGAU (SEQ ID NO: 310) |
| ART21 | Bacteroides plebeius strain AM31-10 | GTCTATATGACTAA GTAATTTCTACTAT GTGTAGAT (SEQ ID NO: 209) | 28 | 36 | GUCUAUAUGACU AAGUAAUUUCUA CUAUGUGUAGAU (SEQ ID NO: 311) |
| ART22 | Moraxella lacunata, strain NCTC10359 | GTCTAACGACCTTT TAAATTTCTACTGT TTGTAGAT (SEQ ID NO: 210) | 27 | 36 | GUCUAACGACCU UUUAAAUUUCUA CUGUUUGUAGAU (SEQ ID NO: 312) |

TABLE 3-continued

| Nuclease Designation | Organism of origin | Conserved DNA sequence | Spacr length | Scaff length | Conserved RNA sequence |
|---|---|---|---|---|---|
| ART23 | *Lachnospiraceae bacterium* (Human gut stool metagenome) isolate UBA10751 | GTTGAATAACCTTA AATAATTTCTACTG TTGTAGAT (SEQ ID NO: 211) | 27 | 36 | GUUGAAUAACCU UAAAUAAUUUCU ACUGUUGUAGAU (SEQ ID NO: 313) |
| ART24 | *Moraxella* sp. VT-16-12 | GTCTAACGACCTTT AAAATTTCTACTAT TTGTAGAT (SEQ ID NO: 212) | 27 | 36 | GUCUAACGACCU UUAAAAUUUCUA CUAUUUGUAGAU (SEQ ID NO: 314) |
| ART25 | *Coprococcus* sp. AF19-8AC | GTTAAGTAACCTAT AGTAATTTCTACTG TTGTAGAT (SEQ ID NO: 213) | 27 | 36 | GUUAAGUAACCU AUAGUAAUUUCU ACUGUUGUAGAU (SEQ ID NO: 315) |
| ART26 | *Coprococcus* sp. AF16-22 | GTTAAGTAACCTAT AGTAATTTCTACTG TTGTAGAT (SEQ ID NO: 214) | 26 | 36 | GUUAAGUAACCU AUAGUAAUUUCU ACUGUUGUAGAU (SEQ ID NO: 316) |
| ART27 | *Ruminococcus* sp. AF37-3AC | GTTTAATAACCCTA TATAATTTCTACTA TTGTAGAT (SEQ ID NO: 215) | 26 | 36 | GUUUAAUAACCC UAUAUAAUUUCU ACUAUUGUAGAU (SEQ ID NO: 317) |
| ART28 | *Leptospira ryugenii* strain YH101 | CTCTAAGAGAAGG TATAAATTTCTACT GTTGTAGAT (SEQ ID NO: 216) | 26 | 36 | CUCUAAGAGAAG GUAUAAAUUUCU ACUGUUGUAGAU (SEQ ID NO: 318) |
| ART29 | *Ruminococcus* sp. AM28-29LB | GTTTAATAACCCTA TATAATTTCTACTA TTGTAGAT (SEQ ID NO: 217) | 27 | 36 | GUUUAAUAACCC UAUAUAAUUUCU ACUAUUGUAGAU (SEQ ID NO: 319) |
| ART30 | *Ruminococcus bromii* strain 5AMG contig000049 | GTTTAATAACCCTA TATAATTTCTACTA TTGTAGAT (SEQ ID NO: 218) | 27 | 36 | GUUUAAUAACCC UAUAUAAUUUCU ACUAUUGUAGAU (SEQ ID NO: 320) |
| ART31 | *Ruminococcus bromii* strain CF01-14 | GTTTAATAACCCTA TATAATTTCTACTA TTGTAGAT (SEQ ID NO: 219) | 26 | 36 | GUUUAAUAACCC UAUAUAAUUUCU ACUAUUGUAGAU (SEQ ID NO: 321) |
| ART32 | *Ruminococcus* sp. AM36-18 | GTTTAATAACCCTA TATAATTTCTACTA TTGTAGATA (SEQ ID NO: 220) | 25 | 37 | GUUUAAUAACCC UAUAUAAUUUCU ACUAUUGUAGAU A (SEQ ID NO: 322) |
| ART33 | *Ruminococcus* sp. JE7A12 | GTTTAATCAACCCT TAGAATTTCTACTA TTGTAGAT (SEQ ID NO: 221) | 27 | 36 | GUUUAAUCAACC CUUAGAAUUUCU ACUAUUGUAGAU (SEQ ID NO: 323) |
| ART34 | *Leptospira ilyithenensis* strain 201400974 | CTCTAAGAGAGGA TATAAATTTCTACT GTTGTAGAT (SEQ ID NO: 222) | 26 | 36 | CUCUAAGAGAGG AUAUAAAUUUCU ACUGUUGUAGAU (SEQ ID NO: 324) |
| ART35 | *Prevotella* sp. P4-98 | GGCTATAATGCCTA AGTAATTTCTACTA TTGTAGAT (SEQ ID NO: 223) | 28 | 36 | GGCUAUAAUGCC UAAGUAAUUUCU ACUAUUGUAGAU (SEQ ID NO: 325) |

A guide polynucleotide, or "gRNA", can be represented by any one of the sequences represented by SEQ ID NO: 178-188 or other suitable gRNA. In some embodiments, the engineered polynucleotide (gRNA) can be split into fragments encompassing a synthetic tracrRNA and crRNA. In some embodiments, gRNAs represented by having at least 80%, or at least 85%, or at least 90%, or at least 95% identity to the sequences represented by any one of SEQ ID NO:178-223 and can include a synthetic tracrRNA and crRNA.

As used herein, "guide nucleic acid" or "guide polynucle-otide" can refer to one or more polynucleotides and can include 1) a guide sequence capable of hybridizing to a target sequence and 2) a scaffold sequence capable of interacting with or complexing with a nucleic acid-guided nuclease as described herein. A guide nucleic acid can be provided as one or more nucleic acids. In specific embodi-ments, the guide sequence and the scaffold sequence are provided as a single polynucleotide. In other aspects, guide nucleic acid may include at least one amplicon targeting fragments.

A guide nucleic acid can be compatible with a nucleic acid-guided nuclease when the two elements can form a functional targetable nuclease complex capable of cleaving a target sequence. In certain methods, a compatible scaffold sequence for a compatible guide nucleic acid can be found by scanning sequences adjacent to a native nucleic acid-guided nuclease loci. For example, native nucleic acid-guided nucleases can be encoded on a genome within proximity to a corresponding compatible guide nucleic acid or scaffold sequence.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occur-ring.

Orthogonal guide nucleic acids that are compatible with a common nucleic acid-guided nuclease can comprise one or more common features. Common features can include sequence outside a pseudoknot region. Common features can include a pseudoknot region. Common features can include a primary sequence or secondary structure.

A guide nucleic acid can be engineered to target a desired target sequence by altering the guide sequence such that the guide sequence is complementary to the target sequence, thereby allowing hybridization between the guide sequence and the target sequence. A guide nucleic acid with an engineered guide sequence can be referred to as an engi-neered guide nucleic acid. Engineered guide nucleic acids are often non-naturally occurring and are not found in nature.

Engineered guide nucleic acids can be formed using a Synthetic Tracr RNA (STAR) system. STAR, when com-bined with a Cas12a protein, can form at least one ribo-nucleoprotein (RNP) complex that targets a specific genomic locus. STAR takes advantage of the natural prop-erties of the CRISPR (Clustered Regularly Interspaced Short Palindromic Repeats) where the CRISPR system functions much like an immune system against invading viruses and plasmid DNA. Short DNA sequences (spacers) from invad-ing viruses are incorporated at CRISPR loci within the bacterial genome and serve as "memory" of previous infec-tions. Reinfection triggers complementary mature CRISPR RNA (crRNA) to find a matching viral sequence. Together, the crRNA and trans-activating crRNA (tracrRNA) guide CRISPR-associated (Cas) nuclease to cleave double-strand breaks in "foreign" DNA sequences. The prokaryotic CRISPR "immune system" has been engineered to function as an RNA-guided, mammalian genome editing tool that is simple, easy and quick to implement. STAR (which includes synthetic crRNA and tracrRNA) when combined with Cas12a protein can form ribonucleoprotein (RNP) complexes that target a specific genomic locus. Engineered guide nucleic acids formed with the RNA (STAR) system can result in a split gRNA. An example of a split gRNA for use as disclosed herein can include the sequence represented by SEQ ID NO:188

In some embodiments, a ribonucleoprotein (RNP) com-plex can include at least one nuclease disclosed herein. In some aspects, a RNP complex can include at least one nuclease having an amino acid sequence of about 75%, about 85%, about 95%, about 99%, or is identical to SEQ ID NOs: 143-177 or 229. In some examples, a RNP complex including a nuclease disclosed herein can further include at least one STAR gRNA. In some other examples, a RNP complex including a nuclease disclosed herein can further include at least one non-STAR gRNA. In some other examples, a RNP complex including a nuclease disclosed herein can further include at least one polynucleotide. In some aspects, a polynucleotide included in a RNP complex disclosed herein can be greater than about 50 nucleotides in length. In some embodiments, a polynucleotide included in a RNP complex disclosed herein can be about 50, to about 150, to about 500, to about 1000 nucleotides, or greater than 1000 nucleotides in length. In some embodiments, more than one nuclease can be added to an RNP complex to affect the overall editing efficiency. In other embodiments, more than one gRNA can be added to the RNP complex to allow for multiplexed editing of more than one site in a single transfection for improved efficiency. In other embodiments, more than one DNA template can be added to the RNP to allow for multiplexed editing at one or more sites based on a specific desired repair outcome.

Nuclease Systems

In other embodiments disclosed herein are targetable nuclease systems. In certain embodiments, targetable nucle-ase system can include a nucleic acid-guided nuclease and a compatible guide nucleic acid (also referred to interchange-ably herein as "guide polynucleotide" and "gRNA"). A targetable nuclease system can include a nucleic acid-guided nuclease or a polynucleotide sequence encoding the nucleic acid-guided nuclease. A targetable nuclease system can include a guide nucleic acid or a polynucleotide sequence encoding the guide nucleic acid.

In general, a targetable nuclease system as disclosed herein can be characterized by elements that promote the formation of a targetable nuclease complex at the site of a target sequence, wherein the targetable nuclease complex includes a nucleic acid-guided nuclease and a guide nucleic acid.

A guide nucleic acid together with a nucleic acid-guided nuclease forms a targetable nuclease complex which is capable of binding to a target sequence within a target polynucleotide, as determined by the guide sequence of the guide nucleic acid.

In general, to generate a double stranded break, in most cases a targetable nuclease complex binds to a target sequence as determined by the guide nucleic acid, and the nuclease has to recognize a protospacer adjacent motif (PAM) sequence adjacent to the target sequence.

A targetable nuclease complex can include a nucleic acid-guided nuclease comprising a sequence of any one of SEQ ID NO: 143-177 and 229 and a compatible guide nucleic acid. A targetable nuclease complex can include a nucleic acid-guided nuclease of any one of SEQ ID NO: 143-151 and a compatible guide nucleic acid. A targetable nuclease complex can include a nucleic acid-guided nucle-ase of any one of SEQ ID NO: 143-177 and a compatible guide nucleic acid represented by SEQ ID NO:178-188. A targetable nuclease complex can include a nucleic acid-guided nuclease encoding a nuclease represented by any one of SEQ ID NO: 1-142 and a compatible gRNA or a gRNA represented by any one of SEQ ID NO:178-188. In certain embodiments, the guide nucleic acid can include a scaffold sequence compatible with the nucleic acid-guided nuclease selected. In any of these embodiments, the guide sequence can be engineered to be complementary to any desired target sequence. The guide sequence selected can be engineered to hybridize to any desired target sequence.

A target sequence of a targetable nuclease complex can be any polynucleotide endogenous or exogenous to a prokaryotic or eukaryotic cell, or in vitro. For example, the target sequence can be a polynucleotide residing in the nucleus of the eukaryotic cell. A target sequence can be a sequence coding a gene product (e.g., a protein) or a non-coding sequence (e.g., a regulatory polynucleotide or a junk DNA). It is contemplated herein that the target sequence should be associated with a PAM; that is, a short sequence recognized by a targetable nuclease complex. The precise sequence and length requirements for a PAM differ depending on the nucleic acid-guided nuclease used, but PAMs can be a 2-5 base pair sequences adjacent the target sequence. Examples of PAM sequences are given in the examples section below, and the skilled person will be able to identify further PAM sequences for use with a given nucleic acid-guided nuclease. Further, engineering of the PAM Interacting (PI) domain may allow programming of PAM specificity, improve target site recognition fidelity, and increase the versatility of a nucleic acid-guided nuclease genome engineering platform. Nucleic acid-guided nucleases may be engineered to alter their PAM specificity, for example as described in Kleinstiver et al., Nature. 2015 Jul. 23; 523 (7561): 481-5, the disclosure of which is incorporated herein in its entirety.

A PAM site is a nucleotide sequence in proximity to a target sequence. In most cases, a nucleic acid-guided nuclease can only cleave a target sequence if an appropriate PAM is present. PAMs are nucleic acid-guided nuclease-specific and can be different between two different nucleic acid-guided nucleases. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some embodiments disclosed herein, a PAM can be provided on a separate oligonucleotide. In such cases, providing PAM on a oligonucleotide allows cleavage of a target sequence that otherwise would not be able to be cleave because no adjacent PAM is present on the same polynucleotide as the target sequence.

Polynucleotide sequences encoding a component of a targetable nuclease system can include one or more vectors. In general, the term "vector" as used herein can refer to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses). Other vectors (e.g., non-episomal mammalian vectors) can be integrated into the genome of a host cell upon introduction into the host cell. Recombinant expression vectors can include a nucleic acid of the invention in a form suitable for expression of the nucleic acid in a host cell, can mean that the recombinant expression vectors include one or more regulatory elements, which may be selected on the basis of the host cells to be used for expression, that is operatively-linked to the nucleic acid sequence to be expressed.

In some embodiments, a regulatory element can be operably linked to one or more elements of a targetable nuclease system so as to drive expression of the one or more components of the targetable nuclease system.

In some embodiments, a vector can include a regulatory element operably linked to a polynucleotide sequence encoding a nucleic acid-guided nuclease. The polynucleotide sequence encoding the nucleic acid-guided nuclease can be codon optimized for expression in targeted cells, such as prokaryotic or eukaryotic cells. Eukaryotic cells can be yeast, fungi, algae, plant, animal, or human cells. Eukaryotic cells can be those derived from an organism, such as a mammal, including but not limited to human, mouse, rat, rabbit, dog, or non-human mammal including non-human primate.

In general, codon optimization can refer to a process of modifying a nucleic acid sequence for enhanced expression in the host cells of interest by replacing at least one codon or more of the native sequence with codons that are more frequently or most frequently used in the genes of that host cell while maintaining the native amino acid sequence. Various species exhibit certain bias for codons of a certain amino acid. As contemplated herein, genes can be tailored for optimal gene expression in a given organism based on codon optimization. Codon usage tables are readily available, for example, at the "Codon Usage Database" available at www.kazusa.orjp and these tables can be adapted in a number of ways. See Nakamura, Y., et al. "Codon usage tabulated from the international DNA sequence databases: status for the year 2000" Nucl. Acids Res. 28:292 (2000). In certain embodiments, provided are codon optimized polynucleotides. In certain embodiments, provided are one or more polynucleotides coding for one or more of an amino acid sequence corresponding any one of SEQ ID NO: 143-177 and 229; or to the amino acid sequence of any of SEQ ID NO: 144, 153, and 229, (in some cases SEQ ID NO: 144; in some cases SEQ ID NO: 153; in some cases SEQ ID NO: 229); or an amino acid sequence that is at least 50, 60, 70, 80, 90, 95, or 100% identical to one or more of an amino acid sequence corresponding any one of SEQ ID NO: 143-177 and 229; or to the amino acid sequence of any of SEQ ID NO: 144, 153, and 229, (in some cases SEQ ID NO: 144; in some cases SEQ ID NO: 153; in some cases SEQ ID NO: 229); wherein the polynucleotide is codon optimized, e.g., codon optimized for E. coli, or codon optimized for S. cerevisiae, or codon optimized for humans. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein.

In certain embodiments, provided herein are one or more codon optimized polynucleotides corresponding to any of SEQ ID NO: 2-4, 6-10, 12-14, 16-18, 20-22, 24-26, 28-30, 32-34, 36-38, 40-42, 44-46, 48-50, 52-54, 56-58, 60-62, 64-66, 68-70, 72-74, 76-78, 80-82, 84-86, 88-90, 92-94, 96-98, 100-102, 104-106, 108-110, 112-114, 116-118, 120-122, 124-126, 128-130, 132-134, 136-138, 140-142, 226-228, and 330 or polynucleotide sequence that is at least 50, 60, 70, 80, 90, 95, or 100% identical to one or more of a polynucleotide sequence corresponding any one of SEQ ID NO: 2-4, 6-10, 12-14, 16-18, 20-22, 24-26, 28-30, 32-34, 36-38, 40-42, 44-46, 48-50, 52-54, 56-58, 60-62, 64-66, 68-70, 72-74, 76-78, 80-82, 84-86, 88-90, 92-94, 96-98, 100-102, 104-106, 108-110, 112-114, 116-118, 120-122, 124-126, 128-130, 132-134, 136-138, 140-142, 226-228, and 330. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. In certain embodiments, provided herein are one or more *E. coli* codon optimized polynucleotides corresponding to any of SEQ ID NO: 2, 6, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 226, and 330 or polynucleotide sequence that is at least 50, 60, 70, 80, 90, 95, or 100% identical to one or more of a polynucleotide sequence corresponding any one of SEQ ID NO: 2, 6, 12, 16, 20, 24, 28, 32, 36, 40, 44, 48, 52, 56, 60, 64, 68, 72, 76, 80, 84, 88, 92, 96, 100, 104, 108, 112, 116, 120, 124, 128, 132, 136, 140, 226, and 330. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. In certain embodiments, provided herein are one or more S. cerivisiae codon optimized polynucleotides corresponding to any of SEQ ID NO: 3, 7, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, and 227 or polynucleotide sequence that is at least 50, 60, 70, 80, 90, 95, or 100% identical to one or more of a polynucleotide sequence corresponding any one of SEQ ID NO: 3, 7, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, and 227. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein. In certain embodiments, provided herein are one or more human codon optimized polynucleotides corresponding to any of SEQ ID NO: 4, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, and 228 or polynucleotide sequence that is at least 50, 60, 70, 80, 90, 95, or 100% identical to one or more of a polynucleotide sequence corresponding any one of SEQ ID NO: 4, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, and 228. In certain embodiments, the sequence codes for one or more additional amino acid sequences at either the N-terminus, the C-terminus, or both, of a polypeptide encoded by the polynucleotide. Types, combinations, N- or C-terminal, and/or order of additional amino acid sequences can be any of those disclosed herein.

A nucleic acid-guided nuclease and one or more guide nucleic acids can be delivered either as DNA or RNA. Delivery of an nucleic acid-guided nuclease and guide nucleic acid both as RNA (unmodified or containing base or backbone modifications) molecules can be used to reduce the amount of time that the nucleic acid-guided nuclease persist in the cell. This may reduce the level of off-target cleavage activity in the target cell. Since delivery of a nucleic acid-guided nuclease as mRNA takes time to be translated into protein, it might be advantageous to deliver the guide nucleic acid several hours following the delivery of the nucleic acid-guided nuclease mRNA, to maximize the level of guide nucleic acid available for interaction with the nucleic acid-guided nuclease protein. In other cases, the nucleic acid-guided nuclease mRNA and guide nucleic acid are delivered concomitantly. In other examples, the guide nucleic acid is delivered sequentially, such as 0.5, 1, 2, 3, 4, or more hours after the nucleic acid-guided nuclease mRNA.

Guide nucleic acid in the form of RNA or encoded on a DNA expression cassette can be introduced into a host cell can include a nucleic acid-guided nuclease encoded on a vector or chromosome. The guide nucleic acid may be provided in the cassette one or more polynucleotides, which may be contiguous or non-contiguous in the cassette. In specific embodiments, the guide nucleic acid is provided in the cassette as a single contiguous polynucleotide.

A variety of delivery systems can be used to introduce a nucleic acid-guided nuclease (DNA or RNA) and guide nucleic acid (DNA or RNA) into a host cell. In accordance with these embodiments, systems of use can include, but are not limited to, yeast systems, lipofection systems, microinjection systems, biolistic systems, virosomes, liposomes, immunoliposomes, polycations, lipid: nucleic acid conjugates, virions, artificial virions, viral vectors, electroporation, cell permeable peptides, nanoparticles, nanowires (Shalek et al., Nano Letters, 2012), exosomes. Molecular trojan horses liposomes (Pardridge et al., Cold Spring Harb Protoc; 2010; doi:10.1101/pdb.prot5407) may be used to deliver an engineered nuclease and guide nuclease across the blood brain barrier.

In some embodiments, an editing template is also provided. An editing template may be a component of a vector as described herein, contained in a separate vector, or provided as a separate polynucleotide, such as an oligonucleotide, linear polynucleotide, or synthetic polynucleotide. In some cases, an editing template is on the same polynucleotide as a guide nucleic acid. In some embodiments, an editing template is designed to serve as a template in homologous recombination, such as within or near a target sequence nicked or cleaved by a nucleic acid-guided nuclease as a part of a complex as disclosed herein. An editing template polynucleotide can be of any suitable length, such as about or more than about 10, 15, 20, 25, 50, 75, 100, 150, 200, 500, 1000, or more nucleotides in length. In some embodiments, the editing template polynucleotide is complementary to a portion of a polynucleotide can include the target sequence. When optimally aligned, an editing template polynucleotide might overlap with one or more nucleotides of a target sequences (e.g. about or more than about 1, 5, 10, 15, 20, 25, 30, 35, 40, or more nucleotides). In some embodiments, when a editing template sequence and a polynucleotide can include a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

In some embodiments, methods are provided for delivering one or more polynucleotides, such as or one or more vectors or linear polynucleotides as described herein, one or more transcripts thereof, and/or one or proteins transcribed therefrom, to a host cell. In some aspects, the invention further provides cells produced by such methods, and organisms can include or produced from such cells. In some embodiments, an engineered nuclease in combination with (and optionally complexed with) a guide nucleic acid is delivered to a cell.

Conventional viral and non-viral based gene transfer methods can be used to introduce nucleic acids in cells, such as prokaryotic cells, eukaryotic cells, mammalian cells, or target tissues. Such methods can be used to administer nucleic acids encoding components of an engineered nucleic acid-guided nuclease system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. Any gene therapy method known in the art is contemplated of use herein. Methods of non-viral delivery of nucleic acids include are contemplated herein. Adeno-associated virus ("AAV") vectors may also be used to transduce cells with target nucleic acids, e.g., in the in vitro production of nucleic acids and peptides, and for in vivo and ex vivo gene therapy procedures.

In some embodiments, a host cell is transiently or non-transiently transfected with one or more vectors, linear polynucleotides, polypeptides, nucleic acid-protein complexes, or any combination thereof as described herein. In some embodiments, a cell in transfected in vitro, in culture, or ex vivo. In some embodiments, a cell is transfected as it naturally occurs in a subject. In some embodiments, a cell that is transfected is taken from a subject. In some embodiments, the cell is derived from cells taken from a subject, such as a cell line.

In some embodiments, a cell transfected with one or more vectors, linear polynucleotides, polypeptides, nucleic acid-protein complexes, or any combination thereof as described herein is used to establish a new cell line can include one or more transfection-derived sequences. In some embodiments, a cell transiently transfected with the components of an engineered nucleic acid-guided nuclease system as described herein (such as by transient transfection of one or more vectors, or transfection with RNA), and modified through the activity of an engineered nuclease complex, is used to establish a new cell line can include cells containing the modification but lacking any other exogenous sequence.

In some embodiments, one or more vectors described herein are used to produce a non-human transgenic cell, organism, animal, or plant. In some embodiments, the transgenic animal is a mammal, such as a mouse, rat, or rabbit. Methods for producing transgenic cells, organisms, plants, and animals are known in the art, and generally begin with a method of cell transformation or transfection, such as described herein.

In certain embodiments, an engineered nuclease complex, "target sequence" can refer to a sequence to which a guide sequence is designed to have complementarity, where hybridization between a target sequence and a guide sequence promotes the formation of an engineered nuclease complex. A target sequence can include any polynucleotide, such as DNA, RNA, or a DNA-RNA hybrid. A target sequence can be located in the nucleus or cytoplasm of a cell. A target sequence can be located in vitro or in a cell-free environment.

In some embodiments, formation of an engineered nuclease complex can include a guide nucleic acid hybridized to a target sequence and complexed with one or more novel engineered nucleases as disclosed herein renders cleavage of one or both strands in or near (e.g. within 1, 2, 3, 4, 5, 6, 7, 8, 9, 10, 20, 30, 40, 50, or more base pairs from) the targeted sequence. Cleavage can occur within a target sequence, 5' of the target sequence, upstream of a target sequence, 3' of the target sequence, or downstream of a target sequence.

In some embodiments, one or more vectors driving expression of one or more components of a targetable nuclease system are introduced into a host cell or in vitro such formation of a targetable nuclease complex at one or more target sites. For example, a nucleic acid-guided nuclease and a guide nucleic acid can each be operably linked to separate regulatory elements on separate vectors. Alternatively, two or more of the elements expressed from the same or different regulatory elements, can be combined in a single vector, with one or more additional vectors providing any components of the targetable nuclease system not included in the first vector. Targetable nuclease system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-guided nuclease and one or more guide nucleic acids. In some embodiments, a nucleic acid-guided nuclease and one or more guide nucleic acids are operably linked to and expressed from the same promoter. In other embodiments, one or more guide nucleic acids or polynucleotides encoding the one or more guide nucleic acids are introduced into a cell or in vitro environment already can include a nucleic acid-guided nuclease or polynucleotide sequence encoding the nucleic acid-guided nuclease.

In some embodiments, when multiple different guide sequences are used, a single expression construct may be used to target nuclease activity to multiple different, corresponding target sequences within a cell or in vitro. For example, a single vector can include about or more than about 1, 2, 3, 4, 5, 6, 7, 8, 9, 10, 15, 20, or more guide sequences. In other embodiments, about or more than about 1, 2, 3, 4, 5, 6, 7, 8, 9, 10, or more such guide-sequence-containing vectors can be provided, and optionally, delivered to a cell in vivo or in vitro.

In some embodiments, methods and compositions disclosed herein can include more than one guide nucleic acid, such that each guide nucleic acid has a different guide sequence, thereby targeting a different target sequence. In accordance with these embodiments, multiple guide nucleic acids can be using in multiplexing, wherein multiple targets are targeted simultaneously. Additionally or alternatively, the multiple guide nucleic acids are introduced into a population of cells, such that each cell in a population received a different or random guide nucleic acid, thereby targeting multiple different target sequences across a population of cells. In such cases, the collection of subsequently altered cells can be referred to as a library.

In other embodiments, methods and compositions disclosed herein can include multiple different nucleic acid-guided nucleases, each with one or more different corresponding guide nucleic acids, thereby allowing targeting of different target sequences by different nucleic acid-guided nucleases. In some such cases, each nucleic acid-guided nuclease can correspond to a distinct plurality of guide nucleic acids, allowing two or more non-overlapping, partially overlapping, or completely overlapping multiplexing events.

In some embodiments, the nucleic acid-guided nuclease has DNA cleavage activity or RNA cleavage activity. In some embodiments, the nucleic acid-guided nuclease directs cleavage of one or both strands at the location of a target sequence, such as within the target sequence and/or within the complement of the target sequence. In some embodiments, the nucleic acid-guided nuclease directs cleavage of one or both strands within about 1, 2, 3, 4, 5, 6, 7, 8, 9, 10, 15, 20, 25, 50, 100, 200, 500, or more base pairs from the first or last nucleotide of a target sequence.

In certain embodiments, the invention provides for methods of modifying a target sequence in vitro, or in a prokaryotic or eukaryotic cell, which can be in vivo, ex vivo, or in vitro. In some embodiments, the method includes sampling a cell or population of cells such as prokaryotic cells, or those from a human or non-human animal or plant (including micro-algae or other organism), and modifying the cell or cells. Culturing may occur at any stage in vitro or ex vivo. The cell or cells may even be re-introduced into the host, such as a non-human animal or plant (including micro-algae). For re-introduced cells, they can be stem cells.

In some embodiments, the method includes allowing a targetable nuclease complex to bind to the target sequence to effect cleavage of the target sequence, thereby modifying the target sequence, wherein the targetable nuclease complex includes a nucleic acid-guided nuclease complexed with a guide nucleic acid wherein the guide sequence of the guide nucleic acid is hybridized to a target sequence within a target polynucleotide. In some aspects, the invention provides a method of modifying expression of a target polynucleotide in in vitro or in a prokaryotic or eukaryotic cell. In some embodiments, the method includes allowing an targetable nuclease complex to bind to a target sequence with the target polynucleotide such that the binding can lead to in increased or decreased expression of the target polynucleotide; wherein the targetable nuclease complex includes an nucleic acid-guided nuclease complexed with a guide nucleic acid, and wherein the guide sequence of the guide nucleic acid is hybridized to a target sequence within the target polynucleotide.

In certain embodiments, the invention provides kits containing any one or more of the elements disclosed in the above methods and compositions. Elements may provide individually or in combinations, and may be provided in any suitable container, such as a vial, a bottle, or a tube. In some embodiments, the kit includes instructions in one or more languages, for example in more than one language.

In some embodiments, a kit comprises one or more reagents for use in a process utilizing one or more of the elements described herein. Reagents may be provided in any suitable container. For example, a kit may provide one or more reaction or storage buffers. Reagents can be provided in a form that is usable in an assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit includes one or more oligonucleotides corresponding to a guide sequence for insertion into a vector so as to operably link the guide sequence and a regulatory element. In some embodiments, the kit includes a editing template.

In some embodiments, a targetable nuclease complex has a wide variety of utility including modifying (e.g., deleting, inserting, translocating, inactivating, activating) a target sequence in a multiplicity of cell types. As such a targetable nuclease complex of the invention has a broad spectrum of applications in, e.g., biochemical pathway optimization, genome-wide studies, genome engineering, gene therapy, drug screening, disease diagnosis, and prognosis. An exemplary targetable nuclease complex includes a nucleic acid-guided nuclease as disclosed herein complexed with a guide nucleic acid, wherein the guide sequence of the guide nucleic acid can hybridize to a target sequence within the target polynucleotide. A guide nucleic acid can include a guide sequence linked to a scaffold sequence. A scaffold sequence can include one or more sequence regions with a degree of complementarity such that together they form a secondary structure.

An editing template polynucleotide can include a sequence to be integrated (e.g., a mutated gene). A sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function. Sequence to be integrated may be a mutated or variant of an endogenous wild-type sequence. Alternatively, sequence to be integrated may be a wild-type version of an endogenous mutated sequence. Additionally or alternatively, sequenced to be integrated may be a variant or mutated form of an endogenous mutated or variant sequence.

In certain embodiments, an upstream or downstream sequence can include from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or about 2500 bp. In some embodiments, an exemplary upstream or downstream sequence has about 15 bp to about 2000 bp, about 30 bp to about 1000 bp, about 50 bp to about 750 bp, about 600 bp to about 1000 bp, or about 700 bp to about 1000 bp.

In some embodiments, the editing template polynucleotide can further include a marker. In certain embodiments, some markers can facilitate screening for targeted integrations. Examples of suitable markers can include, but are not limited to, restriction sites, fluorescent proteins, or selectable markers. In certain embodiments, an exogenous polynucleotide template can be constructed using recombinant techniques.

In one embodiment, an exemplary method for modifying a target polynucleotide by integrating an editing template polynucleotide, a double stranded break is introduced into the genome sequence by an engineered nuclease complex, the break can be repaired via homologous recombination using an editing template such that the template is integrated into the target polynucleotide. The presence of a double-stranded break can increase the efficiency of integration of the editing template.

Disclosed herein are methods for modifying expression of a polynucleotide in a cell. Some methods include increasing or decreasing expression of a target polynucleotide by using a targetable nuclease complex that binds to the target polynucleotide.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules can be proportional to the amount of the amplified DNA products, one can conveniently determine the amount of the amplified products by quantifying the fluorescence of the intercalated dye using conventional optical systems in the art. DNA-binding dye suitable for this application include, but are not limited to, SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and others known by one of skill in the art.

In some embodiments, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan™ probes) resulting in increased specificity and sensitivity. Methods for performing probe-based quantitative amplification are well established in the art.

In some embodiments, an agent-induced change in expression of sequences associated with a signaling biochemical pathway can also be determined by examining the corresponding gene products. Determining the protein level can involve a) contacting the protein contained in a biological sample with an agent that specifically bind to a protein associated with a signaling biochemical pathway; and (b) identifying any agent: protein complex so formed. In one aspect of this embodiment, the agent that specifically binds a protein associated with a signaling biochemical pathway is an antibody, preferably a monoclonal antibody.

In some embodiments, the amount of agent: polypeptide complexes formed during the binding reaction can be quantified by standard quantitative assays. As illustrated above, the formation of agent: polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

In some embodiments, a number of techniques for protein analysis based on the general principles outlined above are known in the art and contemplated herein. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

In some embodiments, in practicing a subject method, it may be desirable to discern the expression pattern of a protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

In other embodiment, an altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays.

In certain embodiments, where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a millisecond.

In practicing any of the methods disclosed herein, a suitable vector can be introduced to a cell, tissue, organism, or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

A target polynucleotide of a targetable nuclease complex can be any polynucleotide endogenous or exogenous to the host cell. For example, the target polynucleotide can be a polynucleotide residing in the nucleus of the eukaryotic cell, the genome of a prokaryotic cell, or an extrachromosomal vector of a host cell. The target polynucleotide can be a sequence coding a gene product (e.g. a protein) or a non-coding sequence (e.g., a regulatory polynucleotide or a junk DNA).

Some embodiments disclosed herein relate to use of an engineered nucleic acid guided nuclease system disclosed herein; for example, in order to target and knock out genes, amplify genes and/or repair certain mutations associated with DNA repeat instability and a medical disorder. This nuclease system may be used to harness and to correct these defects of genomic instability. In other embodiments, engineered nucleic acid guided nuclease systems disclosed herein can be used for correcting defects in the genes associated with Lafora disease. Lafora disease is an auto-somal recessive condition which is characterized by pro-gressive myoclonus epilepsy which may start as epileptic seizures in adolescence. This condition causes seizures, muscle spasms, difficulty walking, dementia, and eventually death.

In yet another aspect of the invention, the engineered/novel nucleic acid guided nuclease system can be used to correct genetic-eye disorders that arise from several genetic mutations Several other embodiments of the invention relate to correcting defects associated with a wide range of genetic diseases which are further described on the website of the National Institutes of Health under the topic subsection Genetic Disorders. Certain genetic disorders of the brain can include, but are not limited to, Adrenoleukodystrophy, Agenesis of the Corpus Callosum, Aicardi Syndrome, Alp-ers' Disease, glioblastoma, Alzheimer's, Barth Syndrome, Batten Disease, CADASIL, Cerebellar Degeneration, Fab-ry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly or other brain disorder contributed to by genetically-linked causationIn some embodiments, a genetically-linked disor-der can be a neoplasia. In some embodiments, where the condition is neoplasia, targeted genes can include one or more genes listed above. In some embodiments, a health condition contemplated herein can be Age-related Macular Degeneration or a Schizophrenic-related Disorder. In other embodiments, the condition may be a Trinucleotide Repeat disorder or Fragile X Syndrome. In other embodiments, the condition may be a Secretase-related disorder. In some embodiments, the condition may be a Prion-related disorder. In some embodiments, the condition may be ALS. In some embodiments, the condition may be a drug addiction related to prescription or illegal substances. In accordance with these embodiments, addiction-related proteins may include ABAT for example In some embodiments, the condition may be Autism. In some embodiments, the health condition may be an inflam-matory-related condition, for example, over-expression of a pro-inflammatory cytokine. Other inflammatory condition-related proteins can include one or more of monocyte chemoattractant protein-1 (MCP1) encoded by the Ccr2 gene, the C C chemokine receptor type 5 (CCR5) encoded by the Ccr5 gene, the IgG receptor IIB (FCGR2b, also termed CD32) encoded by the Fcgr2b gene, or the Fc epsilon R1g (FCER1g) protein encoded by the Fcer1g gene, or other protein having a genetic-link to these conditions. In some embodiments, the condition may be Parkinson's Disease. In accordance with these embodiments, proteins associated with Parkinson's disease can include, but are not limited to, a-synuclein, DJ-1, LRRK2, PINK1, Parkin, UCHL1, Syn-philin-1, and NURR1.

Cardiovascular-associated proteins that contribute to a cardiac disorder, can include, but are not limited to, IL1b (interleukin 1-beta), XDH (xanthine dehy-drogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cas-sette, sub-fam-ily G (WHITE), member 8), or CTSK (cathepsin K), or other known contributors to these conditions.

In some embodiments, the condition can be Alzheimer's disease. In accordance with these embodiments, Alzheim-er's disease associated proteins can include very low density lipoprotein receptor protein (VLDLR) encoded by the VLDLR gene, ubiquitin-like modifier activating enzyme 1 (UBA1) encoded by the UBA1 gene, or for example, NEDD8-activating enzyme E1 catalytic subunit protein (UBE1C) encoded by the UBA3 gene or other genetically-related contributor.

In some embodiments, the condition can be an Autism Spectrum Disorder. In accordance with these embodiments, proteins associated Autism Spectrum Disorders can include the benzodiazapine receptor (peripheral) associated protein 1 (BZRAP1) encoded by the BZRAP1 gene, the AF4/FMR2 family member 2 protein (AFF2) encoded by the AFF2 gene (also termed MFR2), the fragile X mental retardation auto-somal homolog 1 protein (FXR1) encoded by the FXR1 gene, or the fragile X mental retardation autosomal homolog 2 protein (FXR2) encoded by the FXR2 gene, or other genetically-related contributor.

In some embodiments, the condition can be Macular Degeneration. In accordance with these embodiments, pro-teins associated with Macular Degeneration can include, but are not limited to, the ATP-binding cassette, sub-family A (ABC1) member 4 protein (ABCA4) encoded by the ABCR gene, the apolipoprotein E protein (APOE) encoded by the APOE gene, or the chemokine (CC motif) L1g and 2 protein (CCL2) encoded by the CCL2 gene, or other genetically-related contributor.

In some embodiments, the condition can be Schizophre-nia. In accordance with these embodiments, proteins asso-ciated with Schizophrenia In accordance with these embodi-ments, proteins associated with Schizophrenia y include NRG1, ErbB4, CPLX1, TPH1, TPH2, NRXN1, GSK3A, BDNF, DISCI, GSK3B, and combinations thereof.

In some embodiments, the condition can be tumor sup-pression. In accordance with these embodiments, proteins associated with tumor suppression can include ATM (ataxia telangiectasia mutated), ATR (ataxia telangiectasia and Rad3 related), EGFR (epidermal growth factor receptor), ERBB2 (v-erb-b2 erythroblastic leukemia viral oncogene homolog 2), ERBB3 (v-erb-b2 erythroblastic leukemia viral oncogene homolog 3), ERBB4 (v-erb-b2 erythroblastic leukemia viral oncogene homolog 4), Notch 1, Notch2, Notch 3, or Notch 4 or other genetically-related contributor.

In some embodiments, the condition can be a secretase disorder. In accordance with these embodiments, proteins associated with a secretase disorder can include PSENEN (presenilin enhancer 2 homolog (C. elegans)), CTSB (cathe-psin B), PSEN1 (presenilin 1), APP (amyloid beta (A4) precursor protein), APH1B (anterior pharynx defective 1 homolog B (C. elegans)), PSEN2 (presenilin 2 (Alzheimer disease 4)), or BACE1 (beta-site APP-cleaving enzyme 1), or other genetically-related contributor.

In some embodiments, the condition may be Amyotrophic Lateral Sclerosis. In accordance with these embodiments, proteins associated with can include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vas-cular endothelial growth factor C), and any combination thereof or other genetically-related contributor.

In some embodiments, the condition can be a prion disease disorder. In accordance with these embodiments, proteins associated with a prion diseases disorder can include SOD1 (superoxide dismutase 1), ALS2 (amyo-trophic lateral sclerosis 2), FUS (fused in sarcoma), TAR-DBP (TAR DNA binding protein), VAGFA (vascular endothelial growth factor A), VAGFB (vascular endothelial growth factor B), and VAGFC (vascular endothelial growth factor C), and any combination thereof or other genetically-related contributor. Examples of proteins related to neuro-degenerative conditions in prion disorders can include A2M (Alpha-2-Macro-globulin), AATF (Apoptosis antagonizing transcription factor), ACPP (Acid phosphatase prostate), ACTA2 (Actin alpha 2 smooth muscle aorta), ADAM22 (ADAM metallopeptidase domain), ADORA3 (Adenosine A3 receptor), or ADRA1D (Alpha-1D adrenergic receptor for Alpha-1D adrenoreceptor), or other genetically-related contributor.

In some embodiments, the condition can be an immuno-deficiency disorder. In accordance with these embodiments, proteins associated with an immunodeficiency disorder can include A2M [alpha-2-macroglobulin]; AANAT [aryla-lkylamine N-acetyltransferase]; ABCA1 [ATP-binding cas-sette, sub-family A (ABC1), member 1]; ABCA2 [ATP-binding cassette, sub-family A (ABC1), member 2]; or ABCA3 [ATP-binding cassette, sub-family A (ABC 1), member 3]; or other genetically-related contributor.

In some embodiments, the condition can be an immuno-deficiency disorder. In accordance with these embodiments, proteins associated with an immunodeficiency disorder can include Trinucleotide Repeat Disorders include AR (andro-gen receptor), FMR1 (fragile X mental retardation 1), HTT (huntingtin), or DMPK (dystro-phia myotonica-protein kinase), FXN (frataxin), ATXN2 (ataxin 2), or other geneti-cally-related contributor.

In some embodiments, the condition can be a Neurotrans-mission Disorders. In accordance with these embodiments, proteins associated with a Neurotransmission Disorders can include SST (somatostatin), NOS1 (nitric oxide synthase 1 (neuronal)), ADRA2A (adrenergic, alpha-2A-, receptor), ADRA2C (adrenergic, alpha-2C-, receptor), TACR1 (tachy-kinin receptor 1), or HTR2c (5-hydrox-ytryptamine (sero-tonin) receptor 2C), or other genetically-related contributor. In other embodiments, neurodevelopmental-associated sequences can include, but are not limited to, A2BP1 [ataxin 2-binding protein 1], AADAT [aminoadipate aminotransfer-ase], AANAT [arylalkylamine N-acetyltransferase], ABAT [4-aminobutyrate aminotrans-ABCA1 [ATP-binding cas-sette, sub-family A (ABC1), member 1], or ABCA13 [ATP-binding cassette, sub-family A (ABC1), member 13], or other genetically-related contributor.

In yet other embodiments, genetic health conditions can include, but are not limited to Aicardi-Goutieres Syndrome; Alexander Disease; Allan-Herndon-Dudley Syndrome; POLG-Related Disorders; Alpha-Mannosidosis (Type II and III); Alstrom Syndrome; Angelman; Syndrome; Ataxia-Te-langiectasia; Neuronal Ceroid-Lipofuscinoses; Beta-Thalas-semia; Bilateral Optic Atrophy and (Infantile) 3 Optic Atro-phy Type 1; Retinoblastoma (bilateral); Canavan Disease; Cerebrooculofacioskeletal Syndrome 1 [COFS1]; Cerebro-tendinous Xanthomatosis; Cornelia de Lange Syndrome; MAPT-Related Disorders; Genetic Prion Diseases; Dravet Syndrome; Early-Onset Familial Alzheimer Disease; 4 Frie-dreich Ataxia [FRDA]; Fryns Syndrome; Fucosidosis; Fuku-yama Congenital Muscular Dystrophy; Galactosialido-sis; Gaucher Disease; Organic Acidemias; Hemophagocytic Lymphohistiocytosis; Hutchinson-Gilford Progeria Syn-drome; Mucolipidosis II; Infantile Free Sialic Acid Storage 4 Disease; PLA2G6-Associated Neurodegeneration; Jervell and Lange-Nielsen Syndrome; Junctional Epidermolysis Bullosa; Huntington Disease; Krabbe Disease (Infantile); Mitochondrial DNA-Associated Leigh Syndrome and NARP; Lesch-Nyhan Syndrome; LIST-Associated Lissen-5 cephaly; Lowe Syndrome; Maple Syrup Urine Disease; MECP2 Duplication Syndrome; ATP7A-Related Copper Transport Disorders; *LAMA*2-Related Muscular Dystrophy; Arylsulfatase A Deficiency; Mucopolysaccharidosis Types I, II or III; Peroxisome Biogenesis Disorders, Zellweger Syn-drome Spectrum; Neurodegeneration with Brain Iron Accu-mulation Disorders; Acid Sphingomyelinase Deficiency; Niemann-Pick Disease Type C; Glycine Encephalopathy; ARX-Related Disorders; Urea Cycle Disorders; COL1A1/2-Related Osteogenesis Imperfecta; Mitochondrial DNA Deletion Syndromes; PLP1-Related Disorders; Perry Syn-drome; Phelan-McDermid Syndrome; Glycogen Storage Disease Type II (Pompe Disease) (Infantile); MAPT-Related Disorders; MECP2-Related Disorders; Rhizomelic Chon-drodys-plasia *Punctata* Type 1; Roberts Syndrome; Sand-hoff Disease; Schindler Disease Type 1; Adenosine Deami-nase Deficiency; Smith-Lemli-Opitz Syndrome; Spinal Muscular Atrophy; Infantile-Onset Spinocerebellar Ataxia; Hex-osaminidase A Deficiency; Thanatophoric Dysplasia Type 1; Collagen Type VI-Related Disorders; Usher Syn-drome Type 1; Congenital Muscular Dystrophy; Wolf-Hirschhorn Syndrome; Lysosomal Acid Lipase Deficiency; and Xeroderma Pigmentosum.

In other embodiments, genetic disorders in animals tar-geted by editing systems disclosed herein can include, but are not limited to, Hip Dysplasia, Urinary Bladder condi-tions, epilepsy, cardiac disorders, Degenerative Myelopathy, Brachycephalic Syndrome, Glycogen Branching Enzyme Deficiency (GBED), Hereditary Equine Regional Dermal Asthenia (HERDA), Hyperkalemic Periodic Paralysis Dis-ease (HYPP), Malignant Hyperthermia (MH), Polysaccha-ride Storage Myopathy-Type 1 (PSSM1), junctional epdier-molysis bullosa, cerebellar abiotrophy, lavender foal syndrome, fatal familial insomnia, or other animal-related genetic disorder.

In some embodiments of the invention, nuclease and/or gRNA sequences can include sequences having homologous substitution (for example, substitution and replacement are both used herein to mean the interchange of an existing amino acid residue or nucleotide, with an alternative residue or nucleotide) that may occur in the case of amino acids such as basic for basic, acidic for acidic, polar for polar, etc. Non-homologous substitutions are also contemplated; for example, from one class of residue to another or alterna-tively involving the inclusion of non-naturally occurring amino acids such as ornithine (hereinafter referred to as Z), diamin-obutyric acid ornithine (hereinafter referred to as B), nor-leucine ornithine (hereinafter referred to as 0), pyridy-lala-nine, thienylalanine, naphthylalanine and phenylgly-cine.

In certain embodiments disclosed herein engineered nucleic acid guided nuclease constructs can recognize a protospacer adjacent motif (PAM) sequence other than TTTN or in addition to TTTN. In other embodiments, engineered nucleic acid guided nuclease constructs dis-closed herein can be further mutated to improve targeting efficiency or can be selected from a library for certain targeted features.

Other embodiments disclosed herein concern vectors including constructs disclosed herein of use for further analysis and to select for improved genome editing features.

Other embodiments disclosed herein include kits for packaging and transporting nucleic acid guided nuclease constructs and/or novel gRNAs disclosed herein or known gRNAs disclosed herein and further include at least one container. In certain embodiments, several reagents required for the kits can be included for convenience and ease of transport and efficiency In certain embodiments, provided herein is a method of creating a strand break at or near a target sequence in a target polynucleotide comprising contacting the target sequence with a targetable nucleic acid-guided nuclease complex, such as an engineered targetable nucleic acid-guided nuclease complex, e.g., an RNP, as disclosed herein, wherein the compatible guide nucleic acid of the complex targets the target sequence, and allowing the targetable guide nucleic acid-guided nuclease complex to create the strand break. The target polynucleotide can be any suitable target polynucleotide, such as a target polynucleotide in a cellular genome. The target polynucleotide can be a safe harbor site. The method can further include providing an editing template to be inserted in the target sequence. The editing template can comprise any suitable sequence that is desired to be inserted at the break; in certain embodiments the editing template comprises a transgene. In certain embodiments, provided herein is a cell created by the method, or an organism created by the method.

In certain embodiments, the invention provides methods comprising delivering one or more polynucleotides, such as or one or more vectors or linear polynucleotides as described herein, one or more transcripts thereof, and/or one or pro-teins transcribed therefrom, to a host cell. In some aspects, the invention further provides cells produced by such methods, and organisms comprising or produced from such cells. In some embodiments, an engineered nuclease in combination with (and optionally complexed with) a guide nucleic acid is delivered to a cell.

Certain embodiments provide a method for modifying a target polynucleotide by integrating an editing template, a double stranded break is introduced into a genome sequence by an engineered nuclease complex, the break can be repaired via homologous recombination using an editing template such that the template is integrated into the target polynucleotide. The presence of a double-stranded break can increase the efficiency of integration of the editing template.

Additional objects, advantages, and novel features of this disclosure will become apparent to those skilled in the art upon review of the following examples in light of this disclosure.

Appendix A comprising sequence listings is appended hereto and constitutes part of this application The following examples are not intended to be limiting.

IV. EXAMPLES

The following examples are included to demonstrate preferred embodiments of the disclosure. It should be appreciated by those of skill in the art that the techniques disclosed in the examples that follow represent techniques discovered by the inventors to function well in the practice of the present disclosure, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the present disclosure.

Example 1

In one exemplary method, selection criteria were set to identify sequences with <60% AA sequence similarity to Cas12a, <60% AA sequence similarity to a positive control nuclease, and >80% query cover. After some screening rounds, 35 nucleases were identified and referenced herein as ART1-35 for further study. The survey overview is provided in Table 2.

TABLE 2

| ART Nucleases Identified in Screening | | | | | |
|---|---|---|---|---|---|
| ART Name | Protein Reference Number | SEQ ID NO corresponding to Amino Acid sequences | SEQ ID NO corresponding to nucleic acid sequence | % AA to Cpf1 (<80% desired) | % AA to positive control (<60% desired) |
| ART1 | WP_118425113.1 | 143 | 1 | 30.838 | 32.54 |
| ART2 | WP_137013028.1 | 144 | 5 | 34.189 | 33.07 |
| ART3 | WP_073043853.1 | 145 | 11 | 35.982 | 36.72 |
| ART4 | WP_118734405.1 | 146 | 15 | 30.519 | 51.64 |
| ART5 | WP_146683785.1 | 147 | 19 | 30.114 | 32.31 |
| ART6 | WP_117882263.1 | 148 | 23 | 29.421 | 33.49 |
| ART7 | OYP43732.1 | 149 | 27 | 26.323 | 28.64 |
| ART8 | TSC78600.1 | 150 | 31 | 25.379 | 23.01 |
| ART9 | WP_094390816.1 | 151 | 35 | 26.323 | 28.62 |
| ART10 | WP_104505765.1 | 152 | 39 | 31.291 | 32.59 |
| ART11 | WP_151622887.1 | 153 | 43 | 30.654 | 35.55 |
| ART12 | HAW84277.1 | 154 | 47 | 34.872 | 31.33 |
| ART13 | WP_119227726.1 | 155 | 51 | 34.993 | 31.55 |
| ART14 | WP_118080156.1 | 156 | 55 | 32.551 | 35.33 |
| ART15 | WP_046700744.1 | 157 | 59 | 31.456 | 33.92 |
| ART16 | WP_115247861.1 | 158 | 63 | 31.136 | 34.25 |
| ART17 | WP_062499108.1 | 159 | 67 | 31.136 | 34.17 |
| ART18 | WP_154326953.1 | 160 | 71 | 31.113 | 33.28 |
| ART19 | WP_117747221.1 | 161 | 75 | 30.764 | 32.47 |
| ART20 | WP_118211091.1 | 162 | 79 | 30.986 | 32.29 |
| ART21 | WP_118163031.1 | 163 | 83 | 31.134 | 32.54 |
| ART22 | WP_115006085.1 | 164 | 87 | 30.044 | 31.55 |
| ART23 | HCS95801.1 | 165 | 91 | 30.37 | 51.64 |
| ART24 | WP_089541090.1 | 166 | 95 | 30.933 | 33.11 |
| ART25 | WP_120123115.1 | 167 | 99 | 29.978 | 48.88 |
| ART26 | WP_117874294.1 | 168 | 103 | 29.904 | 48.49 |
| ART27 | WP_117951432.1 | 169 | 107 | 29.421 | 33.03 |

TABLE 2-continued

| | | ART Nucleases Identified in Screening | | | |
|---|---|---|---|---|---|
| ART Name | Protein Reference Number | SEQ ID NO corresponding to Amino Acid sequences | SEQ ID NO corresponding to nucleic acid sequence | % AA to Cpf1 (<80% desired) | % AA to positive control (<60% desired) |
| ART28 | WP_108977930.1 | 170 | 111 | 32.099 | 32.69 |
| ART29 | WP_117886476.1 | 171 | 115 | 29.643 | 33.41 |
| ART30 | WP_101070975.1 | 172 | 119 | 29.027 | 32.95 |
| ART31 | WP_117949317.1 | 173 | 123 | 29.198 | 33.18 |
| ART32 | WP_118128310.1 | 174 | 127 | 29.198 | 33.18 |
| ART33 | WP_138157649.1 | 175 | 131 | 27.273 | 29.89 |
| ART34 | WP_135764749.1 | 176 | 135 | 27.004 | 25 |
| ART35 | OYP46450.1 | 177 | 139 | 26.709 | 29.51 |

*nucleic acid sequences correspond to ARTs that have not been optimized using methods as described examples herein

Example 2

In some methods, codon optimization, as described in Example 8, can lower nucleotide sequence similarity in most cases; however, it does not change the amino acid sequence of the protein. Further engineering was applied to sequences to improve the activity of the nucleases outside their native context. The native sequences of the 35 ART nucleases were engineered to include glycine, 6× Histidine, and 3× nuclear localization signal tags.

These Gly-6×His tag were applied for several reasons including: 1) a 6×His tag can be used in protein purification to allow binding to the chromatographic columns for purification, and 2) the N-terminal glycine allows further, site-specific, chemical modifications that permit advanced protein engineering. Further, the Gly-6×His was designed for easy removal, if desired, by digestion with Tobacco Etch Virus (TEV) protease. For these constructs, the Gly-6×His tag was positioned on the N-terminus. Gly-6×His tags are further described in Martos-Maldonado et al., *Nat Commun.* (2018) 17; 9(1): 3307, the disclosure of which is incorporated herein.

The NLS (Nuclear Localization Signal) fragments were added to improve transport to the nucleus. NLS fragments used in these examples were successfully added to Cas9 constructs, as previously described in Perli et al., *Science.* (2016) 353(6304); Ménoret et al., *Sci Rep.* (2015) 5:14410; and EnGen® Spy Cas9 NLS product information from New England Biolabs (NEB), the disclosures of which are incorporated herein in their entirety.

Example 3

In another exemplary method, it is understood that a CRISPR-Cas genome editing system requires, in certain embodiments, at least 2 components: a guide RNA (gRNA) and CRISPR-associated (Cas) nuclease. Guide RNA is a specific RNA sequence that recognizes the targeted DNA region of interest and directs the Cas nuclease to this region for editing. gRNA can comprise two parts: a guide sequence, a 17-29 or longer nucleotide sequence complementary to the target DNA, and a scaffold sequence, which serves as a binding scaffold for the Cas nuclease in order to facilitate editing. In one method, conserved sequences of the gRNAs for nucleases ART1-35 were found by searching 5000 bp upstream of the start codon for each of ART1-ART35 and 1000 bp downstream of the stop codon, and standard methods were used to determine conserved sequences of putative gRNA-coding segments. The conserved DNA sequences for each of ART1-ART35 are provided in Table 3 in the application; these sequences code for conserved portions of gRNA for the respective nuclease, and RNA sequences can be created from these sequences (Conserved RNA sequences in Table 3); in addition, some or all of the RNA sequences may undergo further processing to remove one or more nucleotides from either end, as is known in the art and described elsewhere herein.

Example 4

In another exemplary method, cleavage efficiency of ART nucleases was tested in vivo. Cleavage efficiency of ART nucleases was tested in vivo in *Escherichia coli* (*E. coli*). In these methods, the assay is based on in vivo depletion assay in *E. coli*. First, a glycerol stock of *E. coli* MG1655 harboring a plasmid that expresses the ART nuclease was removed from −80° C. freezer and take 20 μL cells into 2 of 4 mL LB (Luria-Bertani broth) medium with 34 μg/mL chloramphenicol in 15 mL tubes. The cells were cultured at 30° C. and 200 rpm for overnight. Then, 4 mL overnight culture was put into 200 mL LB medium with 34 μg/mL chloramphenicol into 2 of 1 L flasks The cells were cultured at 30° C. and 200 rpm until $OD_{600}$ reached 0.5-0.6. The flasks were put into a shaking water bath incubator at 42° C. and 200 rpm for 15 minutes. Then, the flasks were put in the ice with manually slow shaking and were kept in the ice for 15 minutes. After that, the cells were transferred from flasks to 50 mL tubes (4 tubes for 200 mL cells) and centrifuged at 8000 rpm and 4° C. for 5 minutes to remove supernatant. Then, 50 mL ice-cold 10% glycerol were added for 200 mL culture and the cells were resuspended. The resuspended cells were centrifuged at 8000 rpm and 4° C. for 5 minutes to remove supernatant and 2 mL ice-cold 10% glycerol was added. Cells were resuspended with pipette gently and divided into 50 μL of the competent cells. The mixtures was then aliquoted into 72 chilled 0.1 cm electroporation cuvettes (Bio-rad).

Plasmids containing the 24 gRNAs and one non-targeting control gRNA were diluted in the nuclease-free water to 25 ng/ul. gRNA_EC1 to gRNA_EC23 were targeted 18 target loci which are galK, lpd, accA, cynT, cynS, adhE, oppA, fabI, IdhA, pntA, pta, accD, pheA, accB, accC, aroE, aroB, and aroK genes. 2 μL (50 ng) chilled plasmids were put into the electroporation cuvettes and the electroporation were done at 1800 V. Then, 950 μL LB medium were added into the cuvette and mixed, then the cells were taken out into a 96-deep well plate (Light labs). The 96-deep well plate with cells were put at 30° C. and 200 rpm for 2 hours.

Dilutions were made at 10^0, 10^1, and 10^2 for the recovered cells after 2 hours of culture. Then, 10 µL of cells were put into 90 µL ddH₂O and mixed with pipette. After dilution, 8 µL of cells were taken from each dilution and placed by pipette onto a LB agar plate 34 µg/mL chloramphenicol and 100 µg/mL carbenicillin and allowed to dry without covers for several minutes. Then the covers were put back onto the plates and the plates were returned to culture at 30° C. for overnight. The next day, results were checked by counting the number of colonies.

The depletion assay results using ART1, ART2, ART5, ART6, ART8, ART9, ART10, ART11, and ART11_L679F (also referred to herein as ART11* or ART11 mutant) are provided in FIGS. 1-9 where the data depict percent cutting efficiency=1−(#of colonies plate with on-target gRNA/#of colonies on plate with non-target gRNA)*100%.

Example 5

In another exemplary method, editing efficiency of ART nucleases was tested in vivo in *Escherichia coli* (*E. coli*). In these methods, the assay was based on in vivo editing assay in *E. coli*. First, a glycerol stock of *E. coli* MG1655 harboring a plasmid that expressed the ART nuclease was removed from −80° C. freezer and 20 µL of the stock cells were removed and placed into 4 mL LB medium with 34 µg/mL chloramphenicol in one 15 mL tube. The cells were cultured at 30° C. and 200 rpm for overnight. Then, 1 mL of the overnight culture was put into 50 mL LB medium with 34 µg/mL chloramphenicol and 0.2% arabinose into a 500 mL flask. The cells were cultured at 30° C. and 200 rpm until OD₆₀₀ reached 0.5-0.6. The flasks were then put into a shaking water bath incubator at 42° C. and 200 rpm for 15 minutes. Then, the flasks were put in the ice with manual slow shaking and were kept in the ice for 15 minutes. After that, the cells were transferred from flasks to a 50 mL tube and centrifuged at 8000 rpm and 4° C. for 5 minutes to remove supernatant. Then, 25 mL ice-cold 10% glycerol were added for 50 mL culture and the cells were resuspend. The resuspended cells were centrifuged at 8000 rpm and 4° C. for 5 minutes to remove supernatant and 0.5 mL ice-cold 10% glycerol was added. Cells were resuspended with a pipette gently and then divided into 50 µL of the competent cells. The mixture was then divided into 9 chilled 0.1 cm electroporation cuvettes.

Plasmids containing 3 gRNAs were diluted in the nuclease-free water to 25 ng/ul. gRNA_EC1 to gRNA_EC3 were targeted the galK gene. 2 µL (50 ng) chilled gRNA plasmids and 2 µL (50 ng) ssDNA-used as DNA repair templates-were put into the electroporation cuvettes and the electroporation was done at 1800 V. Then, 950 µL LB media were added into the cuvette and mixed, then the cells were removed from the cuvette and placed into a 1.5 mL tube. The tubes with cells were put at 30° C. and 200 rpm for 2 hours.

After recovery, 5 µL of cells were plated onto a MacConkey agar plate with 34 µg/mL chloramphenicol, 100 µg/mL carbenicillin, and 1% Galactose by pipette and the cells were spread using sterile plating beads. After removing the plating beads, covers were put back to the plates and the plates were returned to culture at 30° C. for overnight. The next day, the editing efficiency was calculated using the following equation.

$$\text{Editing efficiency} = \frac{\text{numbers of white colonies}}{\text{numbers of total colonies}} \times 100\%$$

Figure 10:
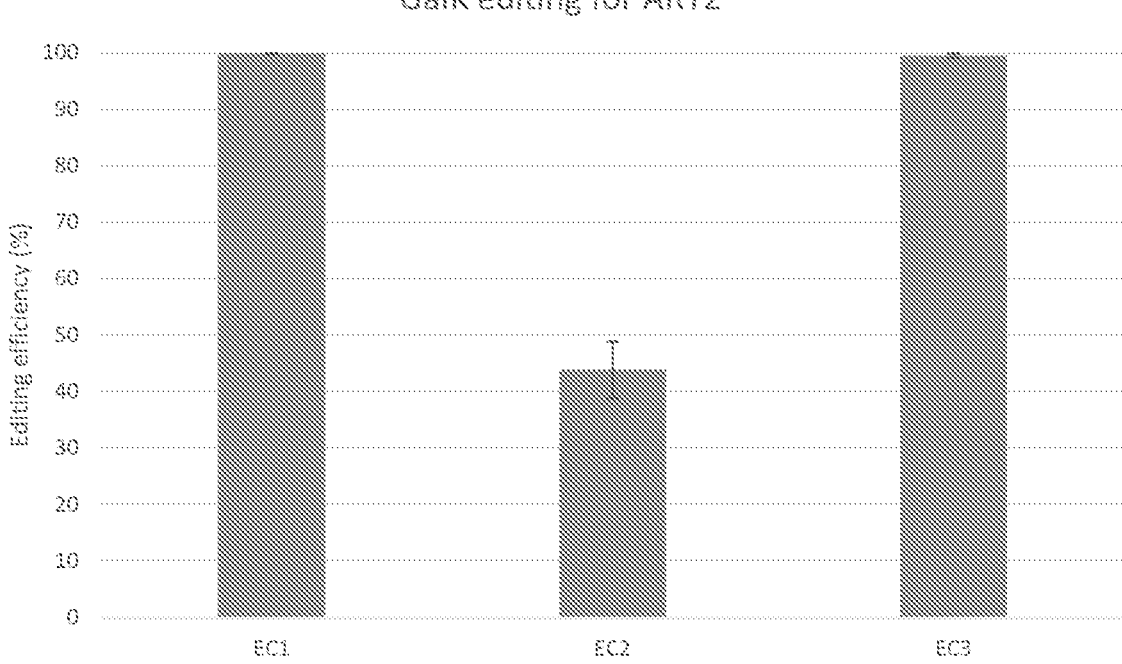
FIG. 10 is an exemplary histogram plot illustrating an experimental GalK editing assay to assess gene editing efficiency of an ART2 nucleic acid-guided nuclease of some embodiments disclosed herein.
Figure 11:
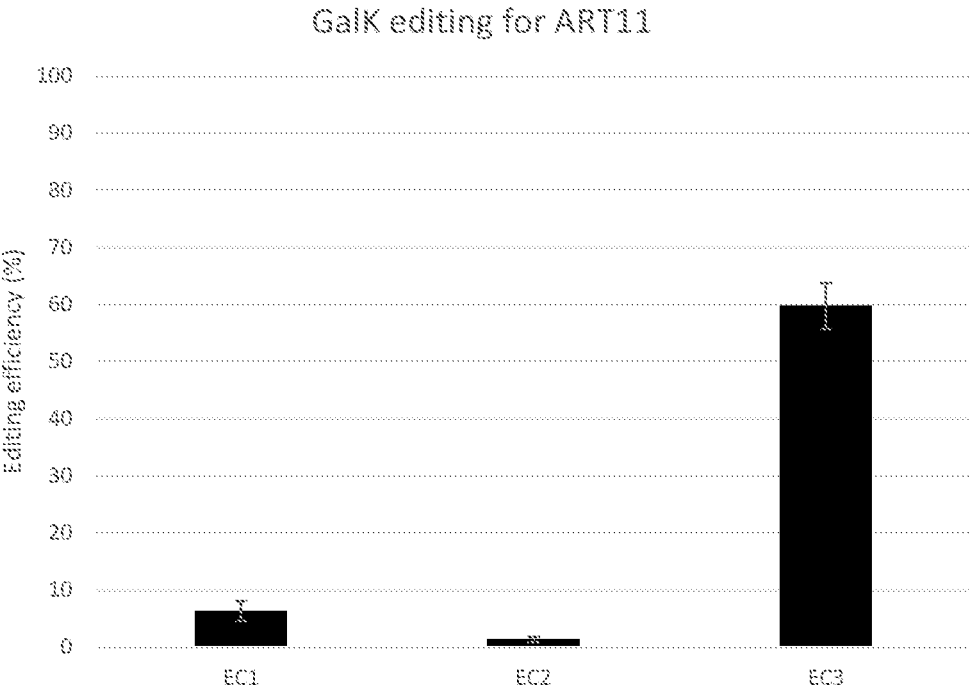
FIG. 11 is an exemplary histogram plot illustrating an experimental GalK editing assay to assess gene editing efficiency of an ART11 nucleic acid-guided nuclease of some embodiments disclosed herein.
Figure 12:
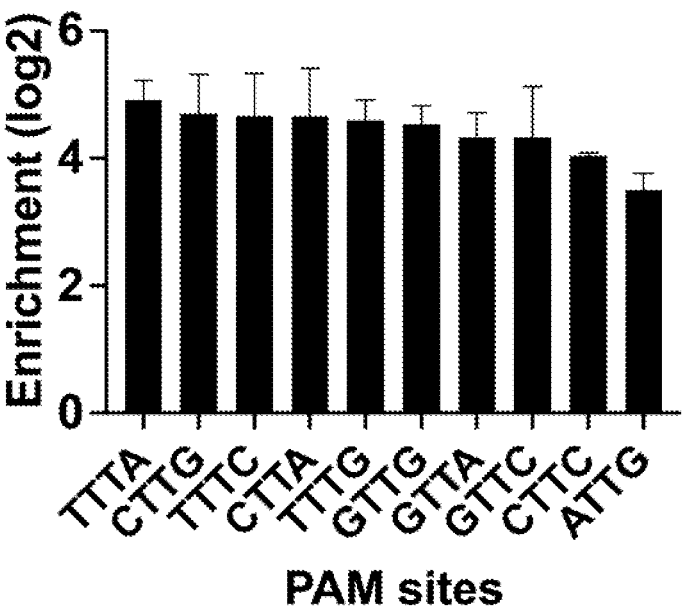
FIG. 12 is an exemplary histogram plot illustrating enrichment for various PAM sites of an ART11 nucleic acid-guided nuclease of some embodiments disclosed herein.

Representative editing assay results using ART2 is provided in FIG. 10 and for ART11 in FIG. 11

Example 6

In another exemplary method, cleavage efficiency of ART nucleases can be tested in vivo in eukaryotic cells. In these methods, the assay is based on the in vivo DNA cleavage assay. Jurkat cells, an immortalized line of human T lymphocyte cells, are cultivated in RPMI 1640 media with 10% Fetal Bovine Serum (FBS) and split regularly before being harvested for the transfection. Two target loci, DNMT1 and TRAC43, are chosen in genomic Jurkat's DNA as targets. Nucleases ART2 and a control nuclease are diluted in the storage buffer (e.g. NaCl 300 mM, Na-phosphate 50 mM, EDTA 0.1 mM, DTT 1 mM, and glycerol 10%) to 20 mg/mL. Analogically, the gRNAs are diluted in the nuclease-free water to 100 µM. The RNA-protein complexes (RNPs) are prepared by mixing 1 µL nuclease solution and 1.5 µL gRNA solution. Complexes are formed in 96-well V-bottom plate during 10 minutes incubation at room temperature.

Cells are counted and their viability was estimated in the NucleoCounter NC-200. Harvested cells are resuspended in the transfection buffer (SF from SF Cell Line 96-well Nucleofector Kit, Lonza) at 100×10⁵ cells/mL concentration. 20 µL of that solution was added to the well with formed RNPs, mixed by pipetting, and transferred to 96-well Nucleocuvette plate (Lonza). Cells are electroporated. In some instances, preceding nucleoporations, two-component gRNAs (split gRNA; STAR) are mixed 1:1 by volume and annealed at 37° C. for 30 minutes to form a gRNA solution. Of note, STAR gRNA is split gRNA where the crRNA and tracr RNA are separate. ART2 mRNA and gRNA (either single or STAR) are co-delivered immediately after resuspension in the appropriate nucleoporation buffer (Lonza) and delivered via an optimized nucleoporator program (Lonza).

Following electroporation, 80 µL of fresh RPMI 1640 media with 10% FBS are added to the Nucleocuvette plate immediately after the electroporation. The solution is mixed and 50 µL was transferred to the 96-well flat-bottom cultivation plate with 150 µL of fresh media. Cells are cultivated for 72 hours before being harvested for DNA extraction. Cells are harvested by centrifugation 1000× g for 10 minutes and washed with buffer (PBS). The supernatant is carefully removed, and the cell pellet is treated with 20 µL preheated QuickExtract DNA Extraction Solution (Lucigen). The plate is placed in the thermocycler (Biorad) and the temperature treatment (e.g. 15 min at 65° C., 15 min at 68° C., 10 min at 95° C., cold down to 4° C.) is applied. Cell debris is harvested by centrifugation, and the supernatant containing genomic DNA is collected. DNA fragments containing target sites are amplified in the PCR reaction and DNA is prepared for sequencing. Illumina-compatible adapter sequences and index sequences for sample identification are added to the target site PCR products during a second round of PCR. The second round PCR products are pooled and loaded onto an Illumina MiSeq sequencing instrument for 2×150 paired-end sequencing. Editing frequency was determined using the Crispresso2 analysis package.

Example 7

Figure 14:
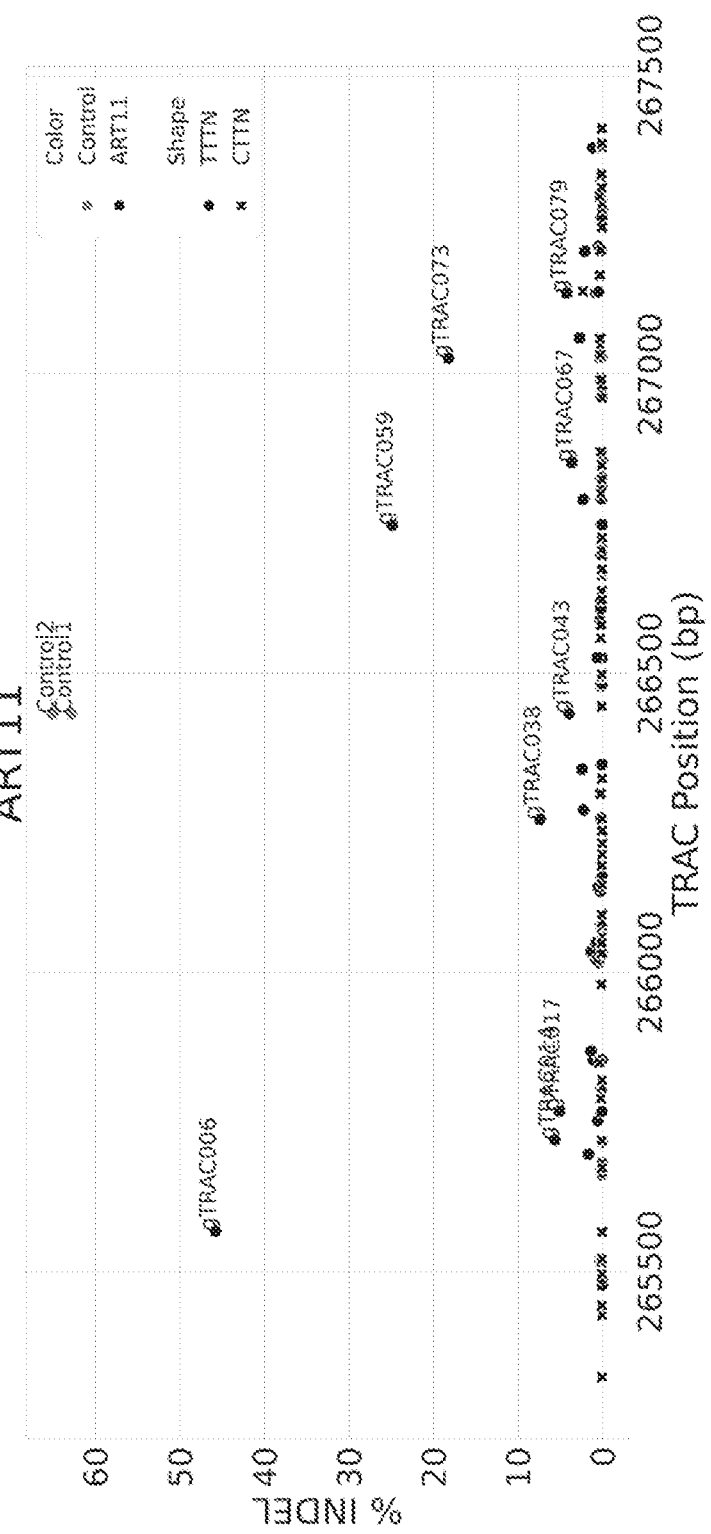
FIG. 14 shows % INDEL for guides tiled across TRAC gene for ART11 in Jurkat cells

In another exemplary method, an ART nuclease RNP was introduced in a mammalian cell for gene editing.
1.1 Cells and Culturing Jurkat, clone E6-1, acute T cell leukemia cells were purchased (ATCC) and cultured in RPMI-1640 (Thermo Fisher) supplemented with 10% fetal bovine serum (FBS, Thermo Fisher) according to manufacturer's instructions. All cell cultures were grown and maintained in a water-humidified incubator containing 5% $CO_2$ at 37° C. (Heracell VIOS 160i, Thermo Fisher).
1.2. Introduction of ART11 RNP in a Mammalian Cell for Gene Editing Ribonucleoproteins (RNPs) were produced by complexing of a single gRNA with ART11 nuclease. Single gRNAs were synthesized (IDT) and recombinant ART11 was produced and purified (Aldevron). Recombinant ART11 nuclease was stored in a 25 mM Tris-HCl pH 7.4, 300 mM NaCl, 0.1 mM EDTA, 1 mM DTT, and 50% (v/v) glycerol buffer at −80° C. prior to use. Single gRNAs were resuspended in IDTE pH 7.5 buffer (IDT) to produce a 100 μM stock and stored at −80° C. prior to use. ART11 nuclease and gRNA were mixed at room temperature for 10 minutes to form RNPs. Following complexing, RNPs were resuspended in the appropriate nucleoporation buffer (eg SF buffer, Lonza) and delivered via an optimized nucleoporator program (eg CA-137, Lonza) to the mammalian cells.
1.3 Harvesting of DNA for Amplicon Sequencing Cells were cultured for 48 hours prior to being harvested for DNA extraction. Cells were harvested via centrifugation (200×g for 5 minutes) to pellet and washed with buffer (PBS). After carefully removing the supernatant, the cell pellet was treated with 20 μL of QuickExtract DNA Extraction solution (Lucigen). The samples were placed in a thermalcycler and a temperature treatment was applied (eg 15 min at 65° C., 15 min at 68° C., 10 min at 95° C., and a cool down to 4C). DNA fragments containing target sites were amplified in a PCR reaction and DNA was prepared for sequencing. Illumina-compatible adapter sequences and index sequences for sample identification are added to the target site PCR products during a second round of PCR. The second round PCR products are pooled and loaded onto an Illumina MiSeq sequencing instrument for 2×150 paired-end sequencing. Editing frequency was determined using the Crispresso2 analysis package. Results are shown in FIG. 14

Example 8

In another exemplary method, codon optimization for non-naturally occurring nucleic acid sequences disclosed herein used the Codon Optimization Tool (Integrated DNA technologies). In this method, an organism was chosen to express the nuclease in for a wide range of applications, such as bacteria (e.g., *Escherichia coli* K12), yeast (e.g., *Saccharomyces cerevisiae*), or multi cell eukaryotes (e.g. *Homo sapiens* (human)) from the column "Organism". Then the DNA bases or Amino acids sequences were loaded into the blank box of the Codon Optimization Tool. Then the sequences were optimized. The generated DNA sequences are codon optimized for bacteria (e.g., *Escherichia coli* K12), yeast (e.g., *Saccharomyces cerevisiae*), or multi cell eukaryotes (e.g. *Homo sapiens* (human)).

Examples of non-naturally occurring nucleic acid sequences which are disclosed herein include ART2 sequences codon optimized for expression in bacteria, such as *Escherichia coli* (e.g., SEQ ID NO: 6), sequences codon optimized for expression in yeast, such as *Saccharomyces cerevisiae* (e.g., SEQ ID NO: 7), sequences codon optimized for expression in multi cell eukaryotes, such as *Homo sapiens* (human) (e.g., SEQ ID NO: 8). Such non-naturally occurring nucleic acid sequences were amplified, cloned, assembled, synthesized, generated from synthesized oligonucleotides or dNTPs, or otherwise obtained using methods known by those skilled in the art. Codon optimized nucleases have been used to edit cell lines by expression from a plasmid in the cell line or were expressed at high levels in a protein production cell line and subsequently purified for editing by RNP.

Example 9

In another exemplary method, more than one ART nuclease RNP is introduced in a mammalian cell for gene editing. Ribonucleoproteins (RNPs) are produced by complexing of a single gRNA or STAR gRNA with each ART nuclease and the mixture of multiple ART nuclease RNP's is used for transfections. Similar to Example 6, single or STAR gRNAs is synthesized and recombinant ART is produced and purified. Recombinant ART nuclease is then stored in a 25 mM Tris-HCl pH 7.4, 300 mM NaCl, 0.1 mM EDTA, 1 mM DTT, and 50% (v/v) glycerol buffer at −80° C. prior to use. Single or STAR gRNAs are resuspended in IDTE buffer (10 mM Tris, 0.1 mM EDTA) pH 7.5 buffer to produce a 100 uM stock and stored at −80° C. prior to use. Just before nucleoporation, recombinant ART are diluted in a working buffer consisting of 20 mM HEPES and 150 mM KCl pH 7.5 and gRNAs are be diluted to a final working concentration with IDTE pH 7.5 buffer (annealed first if STAR, see section 1.4). Following dilutions of the ART nuclease and gRNA, both are be mixed 1:1 by volume (2:1 gRNA to nuclease ratio) at 37° C. for 10 minutes to form RNPs. Following complexing, RNPs are resuspended in the appropriate nucleoporation buffer (Lonza) and delivered via an optimized nucleoporator program (Lonza).

Example 10

In another exemplary method, an ART nuclease is combined with more than one gRNA to construct a multiplex, multitarget RNP and is introduced in a mammalian cell for gene editing. Ribonucleoproteins (RNPs) are produced by complexing of more than one either single or STAR gRNA's that target different sites within the genome with a single ART nuclease or more than one ART nucleases. Similar to Example 6, single or STAR gRNAs are synthesized and recombinant ART is produced and purified. Recombinant ART nuclease is then stored in a 25 mM Tris-HCl pH 7.4, 300 mM NaCl, 0.1 mM EDTA, 1 mM DTT, and 50% (v/v) glycerol buffer at −80° C. prior to use. Single or STAR gRNAs are resuspended in IDTE buffer (10 mM Tris, 0.1 mM EDTA) pH 7.5 buffer to produce a 100 μM stock and stored at −80° C. prior to use. Just before nucleoporation, recombinant ART are diluted in a working buffer consisting of 20 mM HEPES and 150 mM KCl pH 7.5 and gRNAs are diluted to a final working concentration with IDTE pH 7.5 buffer (annealed first if STAR, see section 1.4). Following dilutions of the ART nuclease and gRNA, both are mixed 1:1 by volume (2:1 gRNA to nuclease ratio) at 37° C. for 10 minutes to form RNPs. Following complexing, RNPs are resuspended in the appropriate nucleoporation buffer (Lonza) and delivered via an optimized nucleoporator program (Lonza).

Example 11

In another exemplary method, an ART nuclease RNP is introduced in a mammalian cell for gene editing with a polynucleotide DNA repair template used for directed repair or editing of the target genome. Ribonucleoproteins (RNPs) are produced by complexing of a single or STAR gRNA with ART nuclease and a polynucleotide DNA repair template ranging in size from 20 bp to 20kbp is added to the RNP. Similar to Example 6, single or STAR gRNAs are be synthesized and recombinant ART is produced and purified. Recombinant ART nuclease is then stored in a 25 mM Tris-HCl pH 7.4, 300 mM NaCl, 0.1 mM EDTA, 1 mM DTT, and 50% (v/v) glycerol buffer at −80° C. prior to use. The polynucleotide DNA template is synthesized either from a plasmid stock containing the source DNA material or is synthetic DNA material that has been synthesized commercially (IDT, Genewiz). The DNA template is either single stranded DNA (ssDNA) or double stranded DNA (dsDNA) and has homology arms flaking the insert or editing region proximal to the gRNA cut site. Single or STAR gRNAs are resuspended in IDTE buffer (10 mM Tris, 0.1 mM EDTA) pH 7.5 buffer to produce a 100 μM stock and stored at −80° C. prior to use. Just before nucleoporation, recombinant ART is diluted in a working buffer consisting of 20 mM HEPES and 150 mM KCl pH 7.5 and gRNAs are diluted to a final working concentration with IDTE pH 7.5 buffer (annealed first if STAR, see section 1.4). Following dilutions of the ART nuclease and gRNA, both are mixed 1:1 by volume (2:1 gRNA to nuclease ratio) and the DNA template is added at an optimized concentration at 37° C. for 10 minutes to form RNPs. Following complexing, RNPs are resuspended in the appropriate nucleoporation buffer (e.g. Lonza) and delivered via an optimized nucleoporator program (e.g. Lonza).

Example 12

In another exemplary method, an ART nuclease RNP is introduced in a mammalian cell for gene editing with a mixture of polynucleotide DNA repair templates used for directed repair or editing of the target genome in multiplex. Ribonucleoproteins (RNPs) are produced by complexing of a single or STAR gRNA with ART nuclease and a mixture of polynucleotide DNA repair templates ranging in size from 20 bp to 20kbp is added to the RNP. Similar to Example 6, single or STAR gRNAs are synthesized and recombinant ART is produced and purified. Recombinant ART nuclease is stored in a 25 mM Tris-HCl pH 7.4, 300 mM NaCl, 0.1 mM EDTA, 1 mM DTT, and 50% (v/v) glycerol buffer at −80° C. prior to use. The polynucleotide DNA template is synthesized either from a plasmid stock containing the source DNA material or is synthetic DNA material that has been synthesized commercially (IDT, Genewiz). The DNA template is either single stranded DNA (ssDNA) or double stranded DNA (dsDNA) and has homology arms flaking the insert or editing region proximal to the gRNA cut site. Single or STAR gRNAs are resuspended in IDTE buffer (10 mM Tris, 0.1 mM EDTA) pH 7.5 buffer to produce a 100 μM stock and stored at −80° C. prior to use. Just before nucleoporation, recombinant ART is diluted in a working buffer consisting of 20 mM HEPES and 150 mM KCl pH 7.5 and gRNAs are diluted to a final working concentration with IDTE pH 7.5 buffer (annealed first if STAR, see section 1.4). Following dilutions of the ART nuclease and gRNA, both are mixed 1:1 by volume (2:1 gRNA to nuclease ratio) and the DNA templates are added at an optimized concentration at 37° C. for 10 minutes to form RNPs. Following complexing, RNPs are resuspended in the appropriate nucleoporation buffer (e.g Lonza) and delivered via an optimized nucleoporator program (e.g. Lonza).

Example 13

In this Example, PAM sequences for representative nucleases disclosed herein were evaluated.

A glycerol stock of *E. coli* MG1655 harboring a plasmid that expresses the ART nuclease from −80° C. freezer, 100 μL of cell stock was used to inoculate 4 mL LB medium containing 34 mg/mL chloramphenicol in a 15 mL tube. Cells were cultured in a shaking incubator at 30° C. and 200 rpm overnight (12-16 h). After overnight growth, 1 mL overnight cell culture was added to a 250 mL flask containing 25 mL LB medium containing 34 mg/mL chloramphenicol. Cells were cultured in a shaking incubator at 30° C. and 200 rpm until $OD_{600}$ reached 0.5-0.6. The cells were transferred from flasks to 50 mL tubes and centrifuged at 8000 rpm and 4° C. for 5 minutes to remove supernatant. Then, 25 mL ice-cold 10% glycerol was added, and cells were resuspended. The resuspended cells were centrifuged at 8000 rpm and 4° C. for 5 minutes to remove supernatant and 2 mL ice-cold 10% glycerol was added. Cells were resuspended with pipette gently and divided into 50 μL aliquots of competent cells.

Prepare for electroporation by transferring 50 μL of prepared competent cells into 0.1 cm gap electroporation cuvettes on ice. Add 200 ng of the PAM plasmid library (carrying the on-target site with variable PAM sequences) to the electroporation cuvette and electroporate at 1800 V. Add 950 μL Super Optimal Broth (SOB) medium, mix gently and transfer the entire volume to a 1.5 mL tube. Incubate at 30° C. and 200 rpm for 2 hours. Transfer the cells from each tube to another 15 mL plastic tube containing 4 mL LB medium with 34 mg/mL chloramphenicol and 50 mg/mL kanamycin and incubate overnight. For each culture, add 1 mL of the overnight cell culture to a 250 mL flask containing 25 mL LB medium with 34 mg/mL chloramphenicol, incubate in a shaking incubator at 30° C. and 200 rpm until $OD_{600}$ reached 0.5-0.6. The flasks were put into a shaking water bath incubator at 42° C. and 200 rpm for 15 minutes. Then, the flasks were put in the ice with manually slow shaking and were kept in the ice for 15 minutes. The cells were transferred from flasks to 50 mL tubes and centrifuged at 8000 rpm and 4° C. for 5 minutes to remove supernatant. Then, 25 mL ice-cold 10% glycerol was added, and cells were resuspended. The resuspended cells were centrifuged at 8000 rpm and 4° C. for 5 minutes to remove supernatant and 2 mL ice-cold 10% glycerol was added. Cells were resuspended with pipette gently and divided into 50 μL aliquots of competent cells.

Prepare for a new round of electroporation by transferring 50 μL of prepared competent cells into 0.1 cm gap electroporation cuvettes on ice. Add 100 μg of one of a non-targeting control or on-targeting gRNA plasmid and electroporate at 1800 V. Add 950 μL SOP medium, mix gently and transfer the entire volume to a 1.5 mL tube. Incubate at 30° C. and 200 rpm for 2 hours. Plate an aliquot of recovered cells onto a LB agar plate containing 50 mg/mL kanamycin and 100 mg/mL Carbenicillin and incubate overnight at 30°. Harvest the cells and purify the plasmid. The plasmids are used as template DNA for a PCR reaction with primers miniseq_galKOFF_T225-F2 (TCGTCGGCAGCGTCA-GATGTGTATAAGAGACAGcgtaccctggttggcagcgaatac) (SEQ ID NO: 326) and miniseq_galKOFF_T225-R2 (GTCTCGTGGGCTCGGAGATGTGTATAAGAGACA-Gacgcacgcgttttgccacgatc) (SEQ ID NO: 327). Illumina-compatible adapter sequences and index sequences for sample identification are added to the PCR products during a second round of PCR. The second round PCR products are pooled and loaded onto an Illumina MiSeq sequencing instrument for 2×150 paired-end sequencing.

The VSEARCH tool was used to align the NGS data to the reference PAM library template. The threshold was 0.9 for the alignment. The pandas program was used to filter the aligned data. The threshold was 100% for the data. The normalized reads for each PAM were calculated using the following formula, where PAM hits is the sum of PAM hits after running pandas and the Total hits is the total hits before running VSEARCH:

$$\text{Normalized reads} = \frac{PAM \text{ hits}}{\text{Total hits}} \times 100\%$$

The enrichment was calculated using the following formula, where Normalized ready means normalized reads for each PAM in the non-targeting control experiment and Normalized read$_x$ means normalized read for each PAM in the on-targeting gRNA experiment:

$$\text{Enrichment} = \log2\left(\frac{\text{Normalized read}_y}{\text{Normalized read}_x}\right)$$

Figure 13:
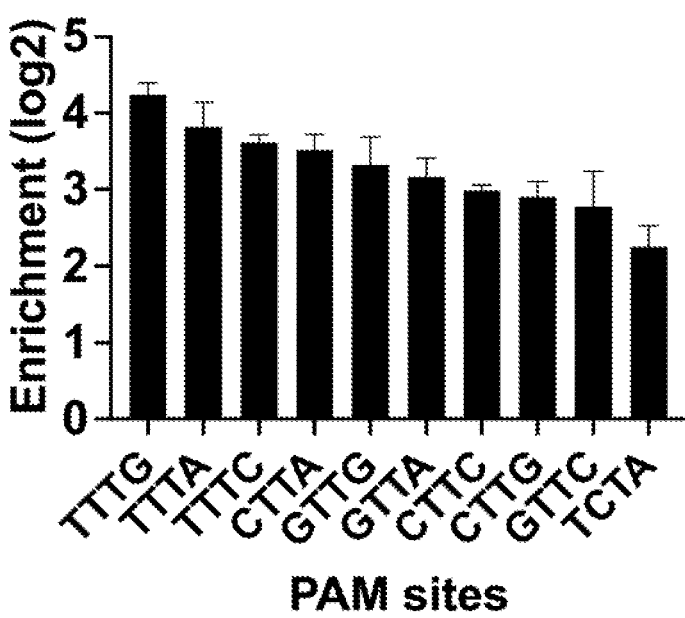
FIG. 13 is an exemplary histogram plot illustrating enrichment for various PAM sites of an ART11 L679F nucleic acid-guided nuclease of some embodiments disclosed herein.

Results for the top hits for PAM sites for ART11 are shown in FIG. 11. Results for the top hits for PAM sites for ART11 L679F are shown in FIG. 13

Example 14

This Example describes site directed mutagenesis (SDM) to develop a mutant nuclease, ART11_L679F
Primer design for Site-Directed Mutagenesis (SDM)

| Name | Sequences |
| --- | --- |
| SDM-ART11-F | AGCTTTACTTCTTTCAAATCTACAATAAAG (SEQ ID NO: 328) |
| SDM-ART11-R | CATCCTTTTCGACAAGAC (SEQ ID NO: 329) |

Exponential Amplification (PCR) Using NEB SDM Kit
a PCR amplication from ART11 using pSC-ART11

| Name | Amount (ul) | Note | Temperate (C.) | Time | Cycle |
| --- | --- | --- | --- | --- | --- |
| SDM-ART11-F | 1.25 | 10-fold dilution | 98 | 30 s | 1 |
| SDM-ART11-R | 1.25 | | 98 | 10 s | 25 |
| pSC-ART11 | 1 | 10 ng/ul | 58 | 30 s | |
| Q5 master mix | 12.5 | | 72 | 5 m | |
| ddH2O | 9 | | 72 | 2 m | 1 |
| | | | 4 | | 1 | b. Run 5 ul PCR products in 1% agarose Gel at 120v for 30 min
Kinase, Ligase & DpnI (KLD) Treatment
Assemble the following reagents:

| | VOLUME |
| --- | --- |
| PCR Product | 1 µl |
| 2× KLD Reaction Buffer | 5 µl |
| 10× KLD Enzyme Mix | 1 µl |
| Nuclease-free Water | 3 µl |

Mix well by pipetting up and down and incubate at room temperature for 30 minutes. Transformation
1. Thaw a tube of NEB 5-alpha Competent *E. coli* cells on ice.
2. Add 5 µl of the KLD mix from Step II to the tube of thawed cells. Carefully flick the tube 4-5 times to mix. Do not vortex.
3. Place the mixture on ice for 30 minutes.
4. Heat shock at 42° C. for 30 seconds.
5. Place on ice for 5 minutes.
6. Pipette 950 µl of room temperature SOC into the mixture.
7. Incubate at 30° C. for 2 hs with shaking (200 rpm).
8. Mix the cells thoroughly by flicking the tube and inverting, then spread 10 and 100 µl onto a selection plate and incubate overnight at 30° C.
9. Pick some colonies for sanger sequencing to find the corrected plasmid.

Appendix A is incorporated herein by reference in its entirety for all purposes.

The foregoing discussion of the disclosure has been presented for purposes of illustration and description. The foregoing is not intended to limit the disclosure to the form or forms disclosed herein. Although the description of the disclosure has included description of one or more embodiments and certain variations and modifications, other variations and modifications are within the scope of the disclosure, e.g., as can be within the skill and knowledge of those in the art, after understanding the present disclosure. It is intended to obtain rights which include alternative embodiments to the extent permitted, including alternate, interchangeable and/or equivalent structures, functions, ranges or steps to those claimed, whether or not such alternate, interchangeable and/or equivalent structures, functions, ranges or steps are disclosed herein, and without intending to publicly dedicate any patentable subject matter.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (335 sequences)

SEQ ID NO: 1 - DNA, 3738 bp, Phocaeicola sp.
atggaaacattttctgggtttacaaatttgtaccctttgtcaaagacattgcggtttagattgattcctgtaggggaaacattgaaacattttattgatagtggaatattggaagaagaccagcatagggctgagagttatgtgaaggtaaaggctattattgatgactatcatagagcttatattgagaattctttatcaggctttgaattacctttggaaagtacaggtaaattcaattctttggaggaatattatttgtatcataatattcgaaataaaacggaagaaattcagaacttgtcatccaaggtcagaactaatctgaggaaacaagtcgtggctcaactaactaagaacgaaatatttaaaagaattgataaaaaagagctgattcagagtgatttgattgattttgttaaaaatgagcctgatgcaaatgagaaaatagcactaatctcagaatttcgtaattttactgtatatttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatagtgaatttctggaatactattcatgatacagttcttgcagaaggagggttgaaaacgattattgcttcattgggtagttatggccttgaaggtattttcctaaagaatgatttgcaacttactgatatatcacaaaaggcaacaggtagttggggtaaaatatcttctgagataaagcaaaaaatagaggtgatgaatcctcaaaagaaaaaagagtcttatgagacttatcaagaacgtatagataagatattcaagtcttataaaagtttttctttagcttttataaatgagtgccttcgtggtgagtataagattgaagattattttctcaagttaggggctgtgaatagcagttcgttacagaaagaaaatcatttttcgcatattctcaatacctatacagatgtgaaagaggtgattggcctttactctgaatcgactgacactaaattaatacaagataatgattccattcaaaagataaaacagttccttgacgcagttaaagacttacaggcttatgtaaaaccattattgggtaatggtgatgaaaccggtaaagatgaaagattttatggcgatttgattgagtattggagtttgcttgacttgattactcctttatataatatggttcgtaattatgtcactcagaagccgtattctgtagataaaataaaaataaatttccagaatcctactttattgaatggctgggaccttaataaagaaacggataatacatctgtaatattgcgtcgtgatggcaaatattatctggccataatgaataacaaatccagaaaagtctttttgaaatatccatcagggacagatagaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtgtataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagttggcaaagtatagctaacataaaagacttgaaagaaggctatttaagtcaggttattcataagatttctgaattgatggtcaaatataatgcgattgtggtgcttgaggatttgaatgctggatttatgcgtggtcgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatactttaggtaaacaaagcggatttctcttttatatccccgcctggaataccagtaaaatggatccggtaacaggttttgtaaatttgtttgatgtgaagtatgaaagtgttgataaggcaaaaagctttttcagtaagttcgattctataaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggcatcgacttatcttcaaatctgaaagatgagataatgcaacgtacagaaaaagaattctttatcgaacttatatccctatttaagcttgtgctacagatgcgtaatagttggacaggtactgatatagattatctggtatcacctgtatgcaatgaaaacggtgaatttttcgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 2 - DNA, 3738 bp, Artificial Sequence
  Description of Artificial Sequence: Synthetic polynucleotide
atggagacattctcagggttcacgaacctgtaccctctgtcgaagaccttacgcttccgcctgattcccgtcggggagacgctgaaacacttcatcgacagcggcatcttagaagaagatcagcatcgtgcagaaagctatgtaaaagttaaggctattatcgatgattatcatcgtgcttatatcgagaacagcttgagtggctttgagcttcctttggaatccacaggaaaatttaatagcttggaggaatactatttgtatcacaatatccgcaacaagaccgaggaaattcagaatttatcatcaaaagttcgtacgaatttgcgtaagcaagtggtagcacaacttacaaagaacgaaatttttaaacgcatcgacaaaaaagaattgattcaatcagatttgattgatttcgtgaagaatgagccggatgcaaacgaaaagattgcattaatctcggagtttcgcaactttactgtctattttaaaggctttcatgagaaccgtcgcaatatgtattcagatgaggaaaaaagtactagtattgcttttcgcttgattcacgaaaatctgccgaagtttatcgataacatggaggtttttgctaagattcagaacacctccatcagcgagaatttcgacgcgattcaaaaagaactttgtccggaattagttactttatgtgagatgttcaagttgggttatttcaacaagacgctttcgcagaaacagatcgacgcctacaacactgtaattgggggaaaaacgacaagtgagggtaagaaaattaagggtctgaatgaatacatcaatttgtacaaccaacagcacaagcaggagaaattaccaaaaatgaagttgctgttcaaacaaatcctgagcgaccgcgaatcggcttcttggttacctgagaagtttgaaaatgattcccaggtggtgggggcgatcgtcaatttctggaacacaattcacgacaccgtcttggcggagggtgggcttaagaccatcatcgcgagtttgggctcctacgggttggagggtattttcttaaagaacgatctgcagttgacagacatcagtcaaaaggccactggaagttggggaaagatttcttcagaaattaagcaaaagattgaggtgatgaacccacaaaagaagaaagagtcatacgaaacctatcaagaacgcattgataaaattttcaagtcgtacaagagcttcagcttagctttcatcaatgagtgtttacgcggagagtacaaaattgaagattatttcctgaaactgggagcggtcaactctagttctctgcaaaaagagaaccatttcagtcacattttaaatacctacactgacgtaaaggaagttatcggcttgtacagcgaatctactgacaccaaactgatccaggataatgattctatccaaaagatcaaacaatttttggatgccgtaaaagacttacaagcctacgtgaaacctcttttgggaaatggggacgagacgggaaaggacgaacgtttctatggtgacttaatcgagtactggagcttacttgacttaatcaccccattatataacatggtgcgtaattacgtcactcaaaagccctattccgtagataagattaaaattaatttccagaatcctactttactgaacggttgggatcttaataaagagactgacaacacgtcggtcatcttacgtcgtgacggtaaatattatttggctattatgaataacaaatctcgcaaggtttttctgaagtacccctctggtaccgaccgtaactgctatgagaagatggagtacaagcttctgccgggggccaacaagatgcttcctaaagtgtttttctccaaaagtcgtatcaatgagtttatgcctaatgaacgtctgctttccaactatgaaaaaggaacccataaaaaaagtggtacatgcttctcgttggatgattgccacaccttaatcgactttttcaaaaagtcgctggataaacatgaagactggaaaaattttgggttcaaattttcggataccagtacatatgaagacatgagcgggttctataaggaagtggagaatcaagggtataaacttagttttaaacctatcgatgcgacgtatgtcgaccaattggtagatgagggtaaaattttcttatttcagatctataataaggatttttccgaacattccaagggaaccccaaatatgcacacgttgtactggaaaatgttgtttgatgaaactaatcttggtgatgttgtgtataagttgaatggggaagccgaagtcttcttccgcaaagcttcaatcaatgtttctcatcctactcacccggccaatatccctatcaaaaagaaaaacctgaaacacaaggacgaggaacgtatcttaaagtacgatttaattaaagacaaacgttacaccgtagaccagtttcagtttcatgtaccaattaccatgaactttaaggcagacgggaatggcaatatcaaccaaaaagcgatcgactatcttcgctctgcaagcgatactcacattattggaattgaccgcggcgagcgcaatctgttgtacctggttgtgattgatggtaacggaaaaatttgcgagcaattctccttaaacgaaatcgaggtagaatataacggcgaaaaatattccaccaactatcacgaccttcttaatgtgaaggagaacgaacgcaaacaggcccgtcaatcgtggcagtctattgcaaatatcaaagacctgaaggagggttacctttcccaggtcatccacaaaatctctgaacttatggtaaagtataacgctattgtagtattggaagaccttaacgcgggcttcatgcgtgggcgtcagaaagtcgaaaaacaagtataccagaagtttgagaagaaattgatcgaaaagttaaactatttagtgttcaaaaaacagtctagtgatcttcccggcgggttgatgcatgcatatcagttggcgaataagttcgagtcgtttaacacgttgggtaagcagtctggatttcttttttacattccggcgtggaatacttcaaagatggatcctgtcactggcttcgtgaatctgtttgatgtaaaatatgaatccgtcgataaggcgaaaagcttctttagcaaattcgactctattcgctataacgtagaacgcgacatgtttgagtggaagtttaattacggcgagttcacaaagaaagccgaggggacgaaaactgattggaccgtttgcagctacggcaatcgtattattacattccgtaatccggataaaaattcccaatgggataataaagagattaatcttacggagaacattaagctgttatttgaacgttttggaatcgatttgtcatccaatttaaaggatgaaatcatgcaacgcacggagaaggaatttttcattgaattaatcagcttgtttaagttggtgctgcaaatgcgcaacagttggacgggcaccgacattgattacttggtaagtcctgtatgcaatgaaaatggtgaattttttgactcacgcaatgtagatgaaaccctgcctcaaaacgctgatgcgaatggcgcgtataatattgcccgcaaggggatgattttactggataaaattaagaaatctaacggggaaaagaaacttgctttatcaattaccaatcgtgaatggttatcgttcgcacaaggttgctgcaagaacggatga

SEQ ID NO: 3 - DNA, 3738 bp, Artificial Sequence
  Description of Artificial Sequence: Synthetic polynucleotide
atggaaacatttagcggattcactaatttgtacccactgtcgaaaactttgcgttttcgtcttatcccagtcggtgaaacgcttaaacactttattgactcgggtatcttggaggaggatcaacatcgcgcggaaagctatgtgaaagtaaaggcgattattgacgactaccatcgtgcatatattgaaaacagcctttccgggttcgagctgccgttagagtctactggaaagtttaacagcttagaagaatactatctgtaccacaacatccgcaataaaacagaggagattcaaaatctgagtagcaaggtccgtacaaacttacgtaaacaggtagtcgcacagttgacaaaaaatgagatttttaagcgtatcgacaaaaaagagcttattcaatctgatttaattgacttcgtgaagaacgaacccgatgcaaacgaaaagatcgcccttatctcggagtttcgcaacttcacagtgtactttaaagggtttcatgaaaaccgccgtaatatgtatagcgacgaggaaaagtcgactagtattgcgttccgtttaattcacgaaaatcttccgaagttcatcgataatatggaggtttttgcaaagattcaaaatactagcatttcggaaaattttgatgcaattcaaaaggagctttgtcctgaactggtgactttatgtgaaatgttcaaattggggtacttcaataaaaccctgtctcagaagcaaatcgacgcttataacactgtgattggcggcaaaactacgtcagaaggcaaaaaaatcaagggtttaaacgaatacatcaacttgtacaatcagcaacacaaacaggaaaagcttccaaagatgaagcttttgtttaagcaaattctgtccgaccgtgaaagcgcctcgtggttaccagaaaaattcgaaaacgattcccaggtagtgggggccattgttaacttttggaacactattcacgatacagtccttgctgaaggcggactgaaaacgattattgcgtcgcttggatcatatggattggagggtattttcttaaaaaatgaccttcaacttacggacatttcacaaaaagcaacaggaagttgggggaaaatctcgtcggaaatcaagcagaaaattgaagtgatgaacccgcagaaaaaaaaggaatcatacgaaacgtaccaagagcgcatcgacaagatttttaagtcctacaaatccttcagccttgcattcatcaatgaatgtttgcgcggtgagtataagatcgaagactacttcttaaagttgggtgccgtaaatagcagcagcttacagaaagaaaatcacttttctcacattcttaatacatatacggatgtcaaagaagtcattggcctgtattctgaatcaactgatacaaaattaattcaagataatgattccatccagaaaatcaaacagttcttagacgcagtgaaggatttacaagcctacgttaaaccattattgggtaatggtgacgaaactgggaaagatgagcgcttctacggtgatttaattgagtactggagtcttttagatcttatcacaccactttacaatatggtccgtaattacgttacccagaaaccttatagtgttgacaaaattaaaattaactttcagaaccccaccttattaaacggctgggacttaaacaaagagactgataacacttcagtgatccttcgccgtgatggtaagtactacttagcaattatgaacaataaaagtcgtaaagtttttctgaagtacccgtccggcactgatcgtaactgttacgaaaagatggagtacaagctgttacctggtgctaacaaaatgcttcctaaagtcttttttagcaagtctcgcatcaatgaatttatgccaaatgaacgtttactgtctaactacgagaagggtacccacaagaagtcagggacctgcttttctttagatgactgtcatactctgatcgatttcttcaagaagtctcttgataagcacgaagattggaagaatttcggcttcaaattttcagacacctctacgtacgaagatatgtctggattttataaggaggtggagaaccaggggtataaattatcgtttaagcctattgatgcaacttatgtcgaccaactggttgatgaggggaaaatctttctttttcagatttataacaaggatttctccgaacattcgaaggggactccaaacatgcacactctgtattggaaaatgttattcgatgagaccaacttaggcgacgttgtgtacaaactgaatggtgaggcagaagtatttttccgtaaagcttcaatcaatgtttctcaccctacccaccccgcgaatattccaatcaagaaaaagaatttgaagcataaggatgaagaacgtattttaaaatacgatctgatcaaggacaaacgttacactgtcgaccagtttcaattccatgtacctattaccatgaatttcaaagctgacgggaacggtaatattaatcaaaaagctatcgactacctgcgcagtgcgtccgacacgcatattatcggtattgaccgtggcgaacgcaacctgttataccttgtcgttatcgacggtaatggtaaaatctgtgaacagttttctttaaatgagatcgaggtcgagtataatggcgaaaaatactcaaccaattaccatgatttacttaacgtcaaagaaaacgagcgcaagcaagctcgtcaatcatggcagtcgattgcaaacattaaagatttaaaggaaggttatctttctcaggtaattcacaagatttccgagttaatggtcaaatataacgccattgtcgtgttggaggatctgaatgctggcttcatgcgcggacgccagaaggttgaaaaacaggtctaccagaagttcgagaagaaattgattgagaaactgaactatctggtttttaaaaaacagtcgtctgatctgccagggggcttaatgcacgcgtatcagttggctaataagtttgagtcgtttaacacacttgggaaacagtccgggtttctgttctatattcctgcgtggaatacatccaagatggacccagtcacagggttcgtcaacttgtttgacgtaaagtacgagtcagttgacaaagcgaaatcattttttagcaaatttgactctattcgctacaacgttgagcgcgatatgtttgagtggaagttcaattatggcgaattcacgaagaaagccgaggggacaaaaaccgattggactgtctgttcttatggcaatcgtattattacgtttcgcaacccagacaagaattcacaatgggacaataaagagattaatttaactgagaacattaagctgttatttgagcgttttgggatcgatctgtcgagcaaccttaaggacgaaattatgcaacgcacagagaaggaattctttattgaactgatctccctttttaaactggtgctgcaaatgcgtaacagttggacgggtactgatattgattacttagtgagtcctgtttgcaacgaaaacggggagttctttgactcacgcaacgtagacgagacattaccccagaacgccgatgcaaatggcgcctataatatcgcgcgtaaagggatgatccttttggataagatcaagaaatccaacggcgaaaaaaaattggcactgtcgatcaccaaccgcgagtggctgagttttgcacaaggatgttgtaaaaacggctga

SEQ ID NO: 4 - DNA, 3738 bp, Artificial Sequence
  Description of Artificial Sequence: Synthetic polynucleotide
atggagacattctctggttttacaaacctttatcccttaagtaagactctgcgcttccgtttgattccagtaggcgagacactgaagcatttcattgactcaggcatcctggaagaggatcagcatcgcgccgagtcgtacgtcaaagttaaagcgattattgacgactatcaccgtgcgtacattgaaaactcgctttcggggtttgaattacccttggagtctaccgggaaatttaatagcctggaggaatactacttgtatcacaacatccgcaataaaactgaagaaatccagaatctgagtagcaaagtgcgtactaatcttcgtaagcaagtagtagcgcagctgacaaagaatgaaatttttaagcgcattgataaaaaagaactgattcaatcggacttgattgactttgtaaaaaacgaacccgacgcaaacgagaaaattgcgctgattagtgagttccgcaacttcacagtctattttaaaggtttccacgagaaccgccgcaatatgtacagtgatgaggaaaaatctacaagtatcgcatttcgtctgattcacgagaaccttcccaaatttatcgacaacatggaagtcttcgccaagattcagaatacctccatctcggagaatttcgacgctatccaaaaggagttgtgtcccgaactggtgactttatgtgaaatgttcaagctgggctattttaataagacattatcccagaaacagatcgatgcgtataacacagtaattggcggaaaaacaacatctgaagggaaaaagatcaaaggacttaatgagtacatcaacttatacaaccaacagcacaagcaggaaaagcttcctaaaatgaaacttttgttcaaacagatcttaagcgatcgcgaatctgcttcttggctgccagaaaagttcgaaaatgatagccaggtagttggggccattgtgaatttctggaacaccatccacgacaccgtacttgcggaaggagggctgaagactattattgcttcgttgggctcctacgggcttgaaggaatcttccttaaaaatgacttgcaactgaccgatatctctcaaaaagctacaggatcatggggaaaaatcagctcagaaattaaacagaagattgaggttatgaacccgcagaagaagaaagaaagctatgaaacgtaccaagagcgtattgacaaaatctttaagtcgtacaagtcttttagtttggcattcattaacgagtgcttgcgcggtgagtacaaaattgaggactacttcttaaagttgggtgctgtaaatagctccagtctgcagaaggaaaatcatttctcacacattcttaacacgtataccgacgtaaaggaagtgattggtctgtactcggaatccacggacactaaattaatccaagacaacgactctattcaaaagattaaacaattcctggacgcagtgaaagatttacaagcttatgtaaagccacttttaggtaacggagatgaaactgggaaggatgagcgtttttatggtgatctgattgagtattggtctttattagacttaatcacgccattgtacaacatggtacgtaactatgtcacacagaaaccttattcggtggataaaatcaagatcaatttccagaatccaactctgctgaatggatgggatctgaataaggaaactgataatacaagcgtcattctgcgtcgtgacggcaaatactatttggcaattatgaacaacaagtcgcgcaaagtgttcctgaagtaccctagcggaactgatcgtaactgttacgaaaaaatggagtacaagcttcttccgggtgcgaataagatgttacctaaagtattcttctctaagagccgcatcaatgagttcatgccgaacgaacgtttgttatccaactacgaaaaaggaacgcacaagaagtcgggtacatgcttttcgcttgatgattgtcacacgttgattgatttttttaagaagagcttggacaaacacgaagattggaagaactttggatttaaattctcagatacttcgacctatgaagacatgtccgggttctataaagaagtggaaaatcaaggatataagctgagcttcaaaccaattgatgcgacctatgtagatcaactggtcgatgaagggaagatctttttattccaaatctataataaagacttctcagagcattccaagggaacgcccaacatgcacacgttgtactggaaaatgctttttgatgaaactaatttaggtgacgtggtgtataaattgaatggtgaagctgaagtattctttcgtaaggcaagtatcaatgtctctcatccgacgcatccagctaatattcccatcaagaagaaaaacctgaaacacaaagatgaagaacgtatcttgaagtacgacttgatcaaagataagcgttatacagtagaccagttccaattccatgtgcctatcaccatgaattttaaagcagatggaaatggaaatatcaatcaaaaagccatcgactacttacgctccgcttcagatactcacattatcggcattgaccgcggagagcgcaatctgttgtatctggtagtgatcgatggtaatggaaagatttgtgaacagttctcattaaacgaaattgaagtagagtataatggtgaaaagtattctacaaactaccatgatttattgaatgttaaagaaaatgaacgtaaacaggctcgccagagctggcagtctatcgcgaatattaaggatctgaaagagggatacctttctcaggtgattcataagatctccgagctgatggtcaaatacaacgccatcgttgtgttagaggaccttaatgcaggtttcatgcgcgggcgccaaaaggtagagaaacaagtataccagaagtttgagaagaaactgatcgaaaaacttaactacttagtgttcaaaaaacagtctagcgatctgccaggcgggcttatgcatgcttatcaactggccaataagttcgagtccttcaacacgttgggtaaacaatctggatttcttttctacattccggcatggaatacgtctaaaatggatcctgtgactggctttgtgaatttatttgatgttaagtatgagagtgtagataaagcgaaaagtttcttttctaaatttgactccattcgctataatgtggaacgtgatatgtttgagtggaagttcaattatggtgagttcaccaaaaaggctgaagggaccaagacagactggactgtgtgcagttatggaaaccgcatcattacttttcgcaaccccgataaaaattctcaatgggacaacaaggagattaacttgacagaaaatatcaagcttttgtttgaacgcttcggcattgatctttcttcgaaccttaaggacgagatcatgcagcgtactgagaaggagttcttcattgaattaatttcattgttcaaattggtcctgcaaatgcgtaatagctggactggtactgacatcgattatttggtctctcccgtgtgtaacgagaatggagagtttttcgactcgcgtaacgtcgatgaaactttgccccaaaacgcagacgccaacggtgcctacaacatcgctcgtaaggggatgatcctgttagataaaatcaagaaatcaaacggagaaaagaaactggctctttctattactaatcgtgagtggctgtcgtttgctcaaggatgctgtaagaatggttga

SEQ ID NO: 5 - DNA, 3594 bp, Sulfurimonas sp.
atgttgtcaaattttacaaatcagtaccaactttcaaaaaccttgcgttttgaactcaaacctgtaggtgatacacttaagcatatagagaaaagtggcttgatagcacaagatgaaatacgctcacaagagtatcaagaagtaaaaacgattatcgataaataccacaaagcttttattgatgaagcacttcaaaatgttgtgcttagtaatcttgaagagtacgaagcactttttttcgagagaaatcgcgatgaaaaagcttttgaaaaattgcaagctgtattgcgtaaagagatagttgcacattttaagcaacaccctcaatacaaaacactttttaaaaaagagcttattaaagctgatttgaaaaattggcaagaactaagcgacgcagaaaaagagcttgtaagccactttgataacttcacaacctactttacaggttttcatgaaaatcgtgccaatatgtacacagatgaagcgaaacactcttctatcgcttaccgtattatccacgaaaatttgcctatttttttaacaaataaaaaactttttgaaacaatcaagcaaaaagcaccacaccttgcacaagaaacgcaagatgccttgcttgaatatttaagtggtgcaatagttgaagatatgtttgagcttagttattttaaccacctactttcacagactcatatcgatctatacaaccaaatgattggcggagtcaaacaagatagtttaaaaattcagggtttaaacgaaaaaatcaatctctatcgtcaagcaaacggcttgtcaaaacgtgaactgccaaatctcaaaccactacacaaacagatacttagtgatcgtgaaacactctcttggcttcctgaatcatttgaaagcgatgaggaacttatgcaaggtgtgcaagcatattttgagagtgaagtattagcttttgagtgctgcgatggtaaggtcaatcttttagagaaactgcctgagcttttgcaccaaacacaagattatgatttttcaaaagtttatttcaaaaacgatctagcacttacagctgcttcgcaagcgatttttaaagattatcgcattataaaagaagcactttgggaagtgaataaacctaaaaaatcaaaagatttagtggcggatgaagagaagttttttaacaagaaaaatagctattttagtattgagcaaatagatggtgccttaaatagtgcgcaactctccgctaacatgatgcactatttccaaagtgaatctacaaaggtaatcgagcaaattcaattgacttacaatgattggaagcgaaacagttcaaataaagaacttctaaaagcttttttagacgcgcttttatcgtatcaacgtcttttaaaaccgcttaatgctccaaacgatcttgaaaaagatgttgctttttatgcctacttcgatgcttattttacgagtttatgcggtgtagtcaagctttacgacaaagtaagaaactttatgaccaaaaagccgtattcacttgaaaaatttaaactcaattttgaaaactcgacactacttgatggttgggatgtcaataaagagtctgataatacggcaattttatttcgcaaagagggcttgtattatctaggtattatgaataaaaagtataacaaagtatttcgcaatatttctagttcacaagatgagggttaccaaaaaattgactataaactattaccaggtgcgaataaaatgcttccaaaagtctttttttctgataagaataaggaatattttaagccaaatgctaagttacttgagagatataaagcgggagagcataaaaaaggggataatttcgacttagatttttgtcacgaattaatagacttttttaaaacttcaatcgaaaaacatcaagattggaaacattttgcttatcagttttcaccgactgagagttacgaagatttaagcggtttttatagagaggttgaacagcaaggttataaaatcagttataaaaatattgcagcaagttttatcgatacattagttgcagaaggtaaactctattttttccagatctacaacaaagacttttctccctatagtaaaggtacgccaaatatgcacactctttattggcgtgcactttttgacgaaaagaatctagctgatgtgatctacaaacttaacgggcaagcggagatatttttccgtaaaaaatcgatcgagtactcccaagagaagctgcaaaaagggcatcaccacgaaatgcttaaagataagtttgcttatccaattatcaaagatcgtcgttttgcttttgataagttccagtttcatgtaccaataacgctcaactttaaagcagagggtaatgaaaacattacgccaaaaacatttgaatacattcgatctaatcccgacaacataaaagttataggtatagatcgtggtgagcgtcacttactctatctttcactcattgatgcagagggtaagatcgtagagcagtttacgctcaatcaaattattaatagctacaacgggaaagaccacgtcatagattatcatgccaaacttgacgcaaaagaaaaagaccgcgacaaagctcgaaaagagtggggaactgtcgaaaacatcaaagaactaaaagagggctatttaagccatgttatccataagatagcaactcttatcattgaacacggtgcagttgtagcgatggaagatctcaactttggctttaaacgtggacgtttcaaagttgaaaagcaagtctatcaaaaatttgaaaaagcacttatcgataagctgaactatcttgtcgataagaaaaaagagcctcataaacttggaggtcttttaaatgcgttgcaactcactagcaagtttcaaagttttgaaaaaatgggtaaacaaaacggctttttgttttatgtacctgcgtggaatacatccaaaatagatcctgttacgggttttgttaatctttttgatacccgttatgcaagtgtagaaaaatccaaagcattttttactaagtttcaatcaatttgctacaacgaagctaaagattacttcgagttagtatttgattataatgatttcacagaaaaagctaaagaaactcgaagcgagtggacactttgtacttatggtgaacgcattgtgagctttagaaacgcggagaaaaatcatcaatgggatagcaaaacaattcatcttacaacagagtttaaaaacctttttggtgagctgcatggtaatgatgtaaaagagtatattttagagcaaaattcagttgagttttttaagtcacttatctatttattaaaaattactttgcagatgcgtaactcaatcacgggtactgatatagactatcttgtctcacccgtcgcagatgaagcagggaatttttacgacagtcgtaaagccgatacatctttaccaaaagatgccgacgcaaacggtgcgtataatatcgctcgtaaaggtttaatgttgatgcatcgcatccaaaacgccgaagatctcaaaaaagtgaacttggcgatttcaaaccgtgactggctccgcaacgctcaaggactggataaatga

SEQ ID NO: 6 - DNA, 3594 bp, Artificial Sequence
  Description of Artificial Sequence: Synthetic polynucleotide
atgctgagtaactttaccaaccagtatcagttatccaagaccttacgtttcgaattgaagccggtcggggatacgttgaaacacatcgagaagagtgggttgatcgcccaagacgaaatccgttcccaagagtaccaagaggttaaaacaatcatcgacaagtaccacaaagcctttatcgacgaagctttacaaaatgtggtgttatccaatcttgaggaatacgaagctcttttcttcgaacgtaatcgtgacgagaaggcgttcgagaaattgcaagctgtattgcgcaaagaaattgtagcacattttaaacaacatccccaatataagaccctttttaagaaggagttaatcaaagctgacctgaaaaattggcaagaactgagcgatgccgagaaagagttggtctcgcactttgataactttactacatacttcacgggtttccacgagaatcgcgccaatatgtacacggacgaggcgaagcacagcagtatcgcctaccgtattattcacgaaaatcttccaatctttcttactaacaagaaactgttcgaaaccattaagcagaaagctccacatttagcccaggaaacgcaggatgcattattggagtatttatccggagccatcgtggaagatatgtttgaacttagttatttcaaccacttgctgagtcagacgcatattgatctgtataatcagatgattggtggagttaagcaggatagtttaaagattcagggtctgaatgagaagattaatctttaccgtcaagcgaatgggctttcgaaacgtgaattgccgaatcttaaaccgctgcataaacaaattctgtcggatcgtgagacattatcttggcttccggaatctttcgagagtgacgaggagctgatgcaaggggtccaggcatatttcgaatctgaagttcttgcctttgaatgttgcgatgggaaggttaacttattagagaaactgccggagttgttacaccaaacacaggattatgattttagtaaagtttacttcaagaacgatttagcattgaccgctgcatcacaggcaatctttaaagactatcgtatcattaaggaggcgttgtgggaggttaataagccgaaaaaatctaaagacttagtcgctgacgaggaaaaattctttaataagaagaactcctacttctctattgagcagattgatggagcgttgaactcggcgcagctgagcgctaacatgatgcactattttcagagtgaatctacaaaggttattgaacaaatccaattgacttataacgactggaagcgtaacagtagcaacaaggaattgcttaaggcattccttgacgcactgctttcttatcagcgtcttttaaagcctttaaatgcccctaatgaccttgagaaggatgtggcattctatgcctactttgacgcctactttacaagcctgtgtggtgtcgttaaactgtacgacaaggtacgtaatttcatgaccaagaagccgtattcgttagagaaatttaagttgaattttgaaaactcgacgcttttagacggttgggatgtcaataaagaatccgacaacactgctattttatttcgtaaggaggggttgtactatctgggtattatgaataaaaagtacaataaggtctttcgtaatatttcatcatcccaagacgagggctatcaaaaaatcgactataaattacttccaggggccaataagatgctgccaaaagtgtttttcagtgataagaataaggagtatttcaagccaaacgccaagctgttggaacgttacaaagccggtgagcacaaaaaaggggataactttgatcttgacttctgtcacgaattgatcgactttttcaagacaagcatcgaaaagcaccaagactggaaacacttcgcctaccagtttagtcccaccgaatcgtacgaggacctttcaggtttttaccgtgaggtggaacaacaggggtacaaaatcagttacaaaaatatcgctgctagctttatcgatacgctggtggcagagggtaaactgtattttttccagatttacaacaaggatttcagtccatactcgaagggaactcccaacatgcacaccttatattggcgtgccttgttcgacgagaagaacttagcggatgtaatttataagttgaacggtcaggccgaaattttttttcgtaaaaagagcatcgaatattcgcaggaaaagttacaaaaggggcaccaccatgagatgttaaaggataagtttgcgtacccaattatcaaggatcgccgctttgcctttgacaagttccagtttcacgtgcctattacactgaattttaaagcggagggcaatgagaatatcactcctaagacgtttgaatatattcgctcgaatcctgataacattaaggtgattgggattgatcgcggcgagcgccacttactttacctgagtttaatcgacgcggaaggtaagattgttgaacagtttacattaaaccaaattatcaatagctacaatgggaaagaccatgtgattgactatcatgccaaattggatgcaaaggaaaaagatcgcgataaggctcgcaaggaatgggggactgtggaaaatatcaaggaattgaaagaaggttatttaagtcatgtaatccataaaatcgcaacccttattatcgagcatggcgctgttgtagcaatggaagaccttaattttggcttcaagcgcgggcgtttcaaagtggagaagcaggtgtatcagaaatttgagaaagctttaattgataaattgaattatttggttgataagaaaaaagagccgcataagttaggtggcttgttgaatgctttgcaattaacgtcaaaatttcagtctttcgaaaagatgggaaaacagaacggtttccttttctatgtgccagcctggaacacatcaaaaattgaccccgtcactgggtttgtaaacctgtttgatactcgctatgcaagcgttgaaaaaagtaaagctttcttcacgaagttccagtcaatttgctacaatgaggccaaggactactttgagttggtgttcgactacaatgactttacagagaaggctaaagaaacacgttcagagtggaccttatgtacatatggggagcgcatcgtgtcttttcgcaatgccgaaaaaaaccaccagtgggactccaaaacgattcatttgaccactgaatttaagaatttatttggggaattgcatgggaatgatgtaaaagagtatattctggaacaaaattctgttgaatttttcaaatcactgatttatcttcttaagattactcttcagatgcgcaattctatcacgggcaccgacattgactacttagtctctccggtcgcagatgaagctgggaatttctatgactcccgtaaggcggacacaagtcttccgaaagacgctgatgcgaacggtgcatacaatatcgcgcgcaaaggactgatgctgatgcaccgtatccagaacgcggaggacttgaagaaggtaaatttggccatctcaaatcgtgattggttgcgcaatgcccaaggtttagataaatga

SEQ ID NO: 7 - DNA, 3594 bp, Artificial Sequence
  Description of Artificial Sequence: Synthetic polynucleotide
atgttaagcaacttcaccaatcagtatcagctaagtaagactctgagattcgagcttaagcctgttggcgataccctaaaacacattgagaaatcaggtctaatagctcaggacgaaattcgtagccaagaatatcaggaagtcaagactattattgataaataccacaaggcctttattgatgaggccctacagaatgtagtcctaagcaatctagaagaatacgaggccttatttttcgaaagaaacagagacgaaaaagcgttcgagaaattacaagcagttttaagaaaggaaatcgtcgctcactttaagcagcacccgcaatataaaacattattcaagaaagagctaatcaaggctgacttaaagaattggcaagaattatccgatgccgagaaagaattggttagtcacttcgacaatttcacgacgtatttcacaggatttcatgagaaccgtgcgaacatgtataccgatgaagcaaaacacagttccatagcttatcgtatcattcacgaaaatctgccgatattcttaactaacaagaaattgtttgagactataaagcaaaaggcgccacatttagcccaagaaacacaggacgctttattggaatatctgagcggggccattgtagaggatatgtttgaactttcatactttaaccaccttttatcccagacccacattgacttatataatcaaatgataggtggggtcaagcaagactcactgaaaattcaaggccttaacgaaaagatcaatttatacaggcaggcgaatggtttgagtaagcgtgaattgccgaatctgaagcccctgcacaaacaaattctgtctgatcgtgaaactctttcctggcttccagaatctttcgaatctgatgaggaactgatgcagggtgtccaagcctacttcgagtctgaagttttagcattcgagtgctgcgatggtaaagttaacctactggagaaactgcccgagcttctgcatcaaacccaggattacgatttctctaaggtatatttcaaaaacgacttagccctaacagcggctagtcaggcaatatttaaggattacagaattattaaagaggctctgtgggaggtgaataaaccgaaaaaatctaaggaccttgtcgccgacgaagaaaagttttttaataaaaaaaacagctattttagcatagaacaaattgacggggcattgaactcagcacaactatctgctaacatgatgcattattttcaaagcgaaagcaccaaggtcattgaacaaattcagttaacttataacgactggaagaggaactcatctaacaaggagctgttaaaggcttttttggatgcattattgtcttatcaaagattgctgaaaccgttgaacgctccaaatgatcttgagaaggacgtagcgttctacgcttacttcgatgcatattttacttccctgtgcggtgtcgtaaagctatatgacaaggtcaggaatttcatgactaaaaaaccatactcacttgaaaaatttaaacttaatttcgaaaattcaacgttattagatggttgggatgtcaataaagagagcgacaatacggctatcctgtttcgtaaagagggtttgtattacctgggaatcatgaataaaaagtacaacaaggtcttcagaaacattagttcatctcaggacgagggttatcagaaaatcgattataaattgttgccaggtgctaacaagatgctgccgaaagttttcttcagcgacaaaaacaaagagtactttaaaccaaacgcaaagttgttggagaggtataaagcgggagagcataagaagggggataattttgatcttgacttctgtcatgaattgattgacttctttaagactagcatagagaagcaccaagattggaaacacttcgcatatcaattcagccccactgagagctacgaggatttatccggcttttacagggaagtagagcagcagggttataagatcagttacaaaaacatagcggcttcttttatagatactttagtagccgagggtaaattatacttctttcaaatttataacaaggatttctccccttattctaagggcactcctaatatgcatactttatattggagggctctttttgacgagaagaacctggcagatgtcatttataagctaaatgggcaagcggaaatttttttccgtaagaagagcatagaatattctcaggagaagctgcaaaagggacatcaccacgaaatgctaaaagacaaattcgcctacccaatcataaaagatagaagatttgcttttgacaaattccagtttcacgtacctatcacattaaactttaaggccgagggaaatgagaacataacaccgaaaacatttgaatatatacgttctaatccagacaatattaaggtgataggaattgaccgtggtgagaggcaccttctatatctatctctaatagacgcagaaggaaagatcgtagaacagtttactctgaaccaaatcataaacagttacaatggcaaggaccacgtaatcgactatcacgctaaattggacgccaaagagaaggatagagacaaggctcgtaaggaatggggtactgtggaaaatatcaaagagcttaaggagggctacctttcacatgttatccacaaaatcgcgactctgataatagaacatggggcagttgtggccatggaggatctaaacttcggattcaagcgtggcagatttaaggtagaaaagcaggtttaccagaagtttgaaaaagccctgatagataaattaaactatctggtcgacaagaagaaagaaccccataaactgggagggttacttaacgcgttacaattgacgagcaagttccaatcctttgagaagatgggcaagcagaacggatttcttttttacgtaccggcatggaacacaagtaaaattgatcccgtcactgggttcgttaatctgtttgacactagatatgccagcgtcgaaaagagcaaagcattttttacaaagtttcagtccatctgttataatgaagccaaagattacttcgaacttgtttttgattacaacgatttcaccgaaaaagctaaagaaactcgttccgaatggacgctatgcacctacggtgaaagaatcgtatccttcaggaacgcagaaaagaaccaccagtgggattccaagactatccatttaacgacggagttcaaaaatcttttcggtgaactacatggcaacgacgtgaaagagtacatacttgaacaaaacagtgtagagttctttaagagtttaatttacttgctgaagatcacgctacagatgagaaactcaataacgggtacggatatcgactacctagtaagtcccgttgctgacgaagcaggcaatttctatgatagtaggaaggctgacacctcacttccaaaagacgcagacgccaacggcgcctataatattgccaggaaaggtcttatgttaatgcatagaatccagaatgccgaagacttaaaaaaagtgaaccttgcaatatctaacagagactggcttcgtaatgcccagggcttagataaatga

SEQ ID NO: 8 - DNA, 3594 bp, Artificial Sequence
  Description of Artificial Sequence: Synthetic polynucleotide
atgttgagcaattttacgaatcagtaccaactgtcaaaaacccttagattcgagctcaagcccgtcggggacacgcttaagcacattgagaagagcgggctgatcgctcaagatgaaatacgatctcaagaatatcaagaagttaaaacgatcatcgataagtatcataaggcgtttatagatgaggcattgcagaacgtggtactgtctaatttggaggaatacgaagcattgttcttcgagcgaaatcgggacgagaaggctttcgaaaagttgcaagccgtgttgcgaaaggaaatagtagcgcatttcaagcaacatccgcaatacaaaacattgtttaaaaaagaacttattaaggcagatctcaagaactggcaagagttgtctgatgctgaaaaagagctggtctcccactttgacaatttcacaacttatttcacagggttccacgaaaatcgcgccaacatgtacacggacgaagcaaagcactcctctattgcgtaccggattatccatgaaaatctgcccatctttctcacgaacaaaaagctctttgaaaccattaagcaaaaggcaccgcatttggctcaggagacccaggacgccctgcttgaatacctgagcggcgcgattgtggaggacatgttcgaactttcctatttcaaccatcttctgtcacaaacccacattgacctgtataaccaaatgattggaggggttaaacaggattccctgaagatccagggcctcaatgagaaaatcaacctttacagacaagccaacggtctttctaaaagggaactcccgaacctcaagcctcttcacaagcaaattttgagcgatcgggaaactcttagttggctcccggaaagcttcgaatccgacgaagagcttatgcaaggagttcaagcctacttcgaaagtgaagtgcttgcattcgagtgttgtgacggcaaagtaaatctgttggaaaagcttcctgagctcttgcatcaaacccaagattatgatttttcaaaggtctattttaaaaacgatctggctcttacagcagcctcccaggccatcttcaaagactaccgaattattaaggaggccctctgggaagttaataagcctaagaaatccaaagatttggttgcggacgaggaaaagttctttaataaaaagaatagctatttttctattgagcagatcgacggcgctttgaactctgctcaactgtcagcaaatatgatgcattactttcagtctgagagcacaaaagtaatcgaacaaattcaattgacctacaacgattggaagcggaacagctctaataaagagcttctgaaagcttttctcgatgcgctcttgtcctaccaaaggctcctcaagccactgaacgcaccaaacgatcttgagaaggacgtcgccttctacgcttactttgatgcatattttaccagcctttgtggtgtagtcaagctgtacgacaaagtacggaattttatgacgaagaagccttacagcctcgagaaatttaaactcaactttgaaaactcaacccttcttgatgggtgggatgtcaataaggagtccgacaatacggctatactttttaggaaagaaggtctctattaccttgggattatgaacaagaaatacaacaaagtattcaggaacataagttccagtcaggatgagggttatcagaaaattgactacaagctccttcctggcgctaacaagatgctcccgaaggtatttttcagcgacaagaataaggaatattttaagcctaatgcgaaattgctcgaacgatataaggccggcgaacataagaagggcgataactttgatcttgacttttgtcatgaactgatagatttctttaaaacgagcatcgagaagcatcaagactggaagcactttgcctaccaattctcacctaccgaatcatacgaagatctgtccggtttttatcgagaagtggaacaacaagggtataaaataagctacaaaaatattgcagcgtccttcatagatacattggtcgcggagggtaagctctacttttttcaaatttacaacaaggacttttcaccctatagcaagggtacccccaacatgcacacactgtactggagagcactctttgatgagaagaacctcgctgacgtcatttataaactgaacggtcaagcagaaatattcttccggaaaaaatctattgagtattcacaggagaaattgcagaaaggacaccatcacgagatgctgaaagacaagttcgcgtatcctattataaaagacaggcgattcgcgtttgataaattccagtttcacgtccctatcacgcttaatttcaaggcagaagggaacgaaaacattacccctaagacattcgaatacattaggagcaacccagataacattaaggtgattggaatcgataggggtgaacgacacttgctgtacctttcactcatcgatgctgagggtaagattgttgagcaatttacgttgaatcaaatcatcaattcctataacggaaaagatcacgttattgattatcacgctaaactcgatgctaaagaaaaggacagagataaagccaggaaagagtggggtacagttgaaaatattaaagaacttaaggaagggtacttgtcacatgttattcacaagattgcaaccctcataattgagcacggggctgtcgtggctatggaagacctcaactttggctttaagcggggacgatttaaagttgagaagcaggtataccaaaaattcgagaaggcgctgattgataagctcaattatctcgtggacaagaagaaggaaccccataagctggggggactccttaatgccctgcagttgacttcaaaattccaatccttcgaaaaaatgggtaagcagaacggatttttgttttacgtacccgcttggaacacctcaaaaattgacccggttaccggcttcgtgaatctctttgacacgcgatacgcttcagttgaaaagtccaaggcttttttcacgaagttccagagtatttgctacaatgaagctaaagactattttgagctggtattcgattacaacgactttacggagaaagccaaggagactcgcagtgagtggaccctttgtacttatggtgagaggatcgtatcattccgcaacgccgagaagaaccaccaatgggactcaaagacgatacatcttaccacagaatttaagaatcttttcggggagctgcatggcaatgacgtaaaggaatatatcctcgagcagaactcagtcgaatttttcaagagtcttatatacctcttgaaaataacactccagatgcggaacagcatcacggggaccgatatcgactaccttgtttcacccgttgccgatgaagccggtaacttctacgacagtcgcaaggcggatacatcacttcctaaagacgccgacgcaaacggtgcttataatatagcccgcaaagggctcatgttgatgcaccgaatccaaaatgctgaagatttgaaaaaagttaaccttgctataagcaaccgagactggctgcggaacgcacagggtctcgacaaatga

SEQ ID NO: 9 - DNA, 3594 bp, Artificial Sequence
  Description of Artificial Sequence: Synthetic polynucleotide
atgttgtccaattttactaatcagtaccagcttagcaaaacacttcgcttcgagttaaagcctgttggtgacacgcttaaacacattgaaaagtcgggactgatcgcacaggatgagattcgctcacaggaatatcaggaggtaaagaccattatcgacaagtatcataaagccttcattgatgaagcattgcagaatgttgtgctgtcaaacctggaagaatatgaagcgttatttttcgaacgtaaccgcgacgaaaaggcgtttgagaaacttcaagccgtactgcgtaaggagatcgtggcccactttaagcagcaccctcagtataaaacactgttcaaaaaggagttgattaaagctgatctgaagaactggcaggagttatcggatgcagagaaagagcttgtaagccattttgacaacttcaccacgtatttcaccggctttcatgaaaaccgtgcgaatatgtataccgatgaagcaaaacattcttcaattgcttaccgcatcatccatgaaaaccttccaatttttcttacaaacaagaaactttttgaaacaattaaacaaaaggcgccgcacctggcgcaagaaacccaggatgccctgttagagtatttatcaggcgctattgtagaagatatgtttgagctgagttattttaaccacttgctgagtcaaacgcatatcgacctttataatcaaatgattgggggcgtgaaacaggattcgttaaaaatccaaggacttaacgagaagatcaatttgtaccgccaggcgaacgggctgtcaaaacgcgagttgccaaatttgaaaccgttgcataaacagattttatccgaccgcgagacgttgtcgtggttacccgaatcctttgagtccgacgaagaattgatgcaaggtgttcaagcttattttgaatcggaggtcctggcctttgaatgctgcgatgggaaggtaaacctgttggagaagttgccagaacttctgcaccaaacccaggactatgatttcagcaaggtatacttcaaaaacgacctggcgttaactgctgcctctcaggccattttcaaagattaccgcattattaaggaggccctgtgggaggtgaacaaaccaaaaaagagtaaggatttggtagcagatgaggaaaaattcttcaataagaaaaatagttatttcagcatcgaacaaattgacggtgccttaaactcagcccaattgtcggctaatatgatgcattattttcagtcggagtcaacgaaagtcatcgaacagattcagctgacctataatgattggaagcgcaactcatctaataaggaattgctgaaggccttcctggatgcgttactgtcgtaccagcgccttcttaagccgttaaacgccccgaatgacttagagaaggatgtagcgttctacgcctatttcgacgcgtatttcacatctctttgtggggttgtgaagttatatgataaagtccgtaactttatgaccaagaaaccatattcactggaaaagttcaagctgaattttgagaattcgacgttgttagatggctgggatgtgaacaaggagtctgacaacacagctattttatttcgcaaagagggtctttactatcttggaatcatgaataagaagtataacaaggtctttcgcaacatcagttccagtcaggacgagggataccagaagatcgattacaaattgttaccaggagctaataagatgttgcccaaagtgtttttctcggataagaacaaagaatacttcaagcctaacgccaaactgttggaacgctataaggcgggagaacataagaaaggtgataattttgacttagatttttgtcatgagcttatcgactttttcaagacatcgattgaaaaacatcaggattggaagcattttgcctaccagttctcccccacagagtcgtacgaggacctgagtgggttctatcgcgaagttgaacaacaaggatataaaatttcctacaaaaatatcgcggcgagctttatcgatacactggtcgcggaggggaaactttatttcttccagatctataacaaagacttctcaccatattctaagggcactccgaatatgcacaccttgtattggcgcgcactgttcgatgagaagaacttggctgatgtgatctataaactgaatggtcaggcggaaattttctttcgcaaaaaatccatcgaatattcgcaggaaaagcttcagaaaggtcaccaccatgaaatgttgaaggataagttcgcctaccccattattaaggatcgtcgttttgctttcgacaaattccaattccacgtgccaatcacattgaattttaaagctgagggcaatgagaacatcacgccaaaaacgtttgagtatatccgctcaaatccagataacatcaaggtgatcgggatcgatcgtggagagcgtcaccttctgtatttgtcgttgatcgacgcggagggcaagatcgtggagcaatttacgcttaaccagattattaatagctataatggtaaggaccacgtcattgattaccatgccaagctggatgctaaggagaaggaccgcgacaaggcgcgcaaggaatggggaacagtcgagaatatcaaagagctgaaagaggggtacttatctcatgtcattcacaaaatcgccacgttaattatcgagcatggggccgtggtagcaatggaggatctgaactttggcttcaaacgtggtcgctttaaagtggagaagcaggtataccaaaaatttgaaaaagcacttatcgacaaacttaactacctggtggacaaaaagaaagaaccacataaattaggcggcctgttgaacgccctgcaactgacctctaaatttcagtccttcgagaaaatgggtaaacagaatgggtttttgttctacgttcccgcgtggaacacatcgaaaattgatccagttacagggtttgtcaacctttttgatacacgctatgcaagcgtggaaaaaagtaaagccttcttcaccaagtttcagtccatctgctacaatgaagccaaagactattttgaactggtctttgattacaacgactttacggagaaagcaaaagaaacccgttccgagtggacgctttgcacgtatggggaacgcattgtgtcgtttcgtaacgctgagaagaaccaccagtgggactctaagacgatccaccttacgacggaattcaaaaatctttttggagaattacatggtaatgacgttaaagagtatattctggagcagaattcggttgaattctttaagagcctgatctatttgttgaagatcacccttcagatgcgcaattccattacaggtacagatattgactatttggtcagtccggtagcggacgaagcggggaatttttatgattcccgcaaagcagatactagtcttcctaaggacgctgatgcaaacggagcatataacatcgcccgtaaaggacttatgttaatgcatcgtattcaaaatgcagaggatcttaagaaagtgaatcttgccatcagtaatcgcgattggttacgcaacgcacagggcctggacaagtga

SEQ ID NO: 10 - DNA, 3594 bp, Artificial Sequence
  Description of Artificial Sequence: Synthetic polynucleotide
atgctgtcgaacttcacgaatcaatatcagcttagtaaaacgttacgcttcgagttaaaaccagttggtgatactttaaaacatattgagaagagtggcctgattgcacaggacgagattcgctctcaggagtaccaggaagttaagacaatcattgataaatatcacaaggctttcattgatgaggcattacaaaacgttgtactttctaacctggaagagtatgaggctttgttttttgaacgtaaccgcgacgagaaggctttcgagaagctgcaagcagtgttacgcaaagagatcgtcgcgcattttaagcaacacccgcagtataagacattgttcaagaaagaattaatcaaagcagacctgaaaaattggcaggagctttctgacgctgagaaggagctggtcagccactttgacaatttcactacatatttcacgggattccatgagaaccgtgctaacatgtacacggatgaagccaaacatagttctattgcttaccgtatcattcacgagaatctgccaatctttttgactaacaaaaagttgttcgagacgatcaagcaaaaggcaccgcacctggcgcaagagacccaagacgccttgttagagtatttgtccggagccatcgtcgaggacatgtttgaattgtcttatttcaatcatcttcttagtcaaacccacatcgatttgtataatcaaatgattggtggcgtaaagcaggattcgttaaaaatccagggtcttaatgaaaaaatcaacctgtatcgtcaagcgaacggattatctaaacgcgaacttccgaatctgaaaccacttcataagcaaatcttgtctgaccgcgagactctgagctggttacccgagtcgttcgagagcgatgaagagttgatgcagggggtacaggcatacttcgagtcggaggtcttagcatttgagtgctgcgacggaaaggtgaatcttctggaaaaattaccggagttgcttcaccaaactcaggactacgacttttccaaagtctatttcaaaaacgacttggctttgaccgcagcgagccaagcaattttcaaggattatcgtattatcaaggaggcactttgggaagtcaacaagcccaaaaagagtaaagacctggtcgctgatgaggaaaaatttttcaataagaagaatagctacttctctattgagcaaattgacggggctcttaactccgcgcagctttcagcgaacatgatgcattattttcagtcggagtctactaaagtaatcgagcagatccagttaacctacaacgactggaagcgcaacagtagtaacaaggagttacttaaggcgtttttggatgccttattatcctaccaacgtctgttaaagcccttaaacgcacctaacgacctggaaaaggatgtagcattctacgcttacttcgatgcttatttcaccagcctttgtggagttgtgaagctgtacgataaagtacgtaattttatgactaagaaaccgtacagtttggagaagtttaagctgaattttgaaaacagcacgctgttggatggttgggacgtcaacaaggagtcagacaacaccgccatcttatttcgcaaggaaggtttatattacctgggtattatgaataagaagtacaacaaagtattccgcaacattagttctagccaagatgagggctatcaaaagatcgattacaaactgttgccgggtgcaaacaaaatgcttccaaaggtctttttctctgataaaaacaaggaatactttaaacctaatgctaaacttttagaacgctacaaagccggcgagcacaaaaagggcgacaacttcgatttagacttctgccacgagttgatcgacttcttcaagacgtctattgagaaacaccaagattggaaacatttcgcatatcaattttcgcctactgagagttacgaagatctgtccggtttctaccgcgaagtcgagcaacagggctacaaaattagctacaaaaatattgcggcgtctttcatcgacacgctggtggctgaaggaaagctgtatttttttcaaatctataacaaggacttctctccatatagcaaaggtaccccgaacatgcatacactgtactggcgcgctcttttcgacgaaaagaaccttgcagacgtaatctacaagctgaacggtcaagctgaaatttttttccgtaagaagtcaatcgaatacagccaagaaaaattacagaaaggccaccatcatgaaatgttgaaagataaatttgcatacccaattatcaaagatcgtcgcttcgctttcgataaattccagttccatgttcccattaccctgaactttaaggcggaggggaacgaaaacattacccctaaaaccttcgagtacattcgttccaacccggacaatatcaaggttatcggcatcgaccgcggtgaacgccatctgttatatcttagcttgatcgatgcggaaggtaagattgtcgagcaattcacccttaaccagatcattaactcatataatggtaaggaccacgtaatcgactatcatgcaaagcttgacgccaaggagaaggatcgcgacaaggcgcgtaaagaatggggcacagttgagaacattaaggagctgaaagaaggttacttaagtcatgtcattcacaaaattgcaacactgatcatcgaacatggtgccgtggtcgcaatggaggacctgaattttggattcaagcgcggtcgctttaaggtggaaaaacaagtctatcaaaaatttgaaaaagctttaattgataaacttaactaccttgttgacaagaaaaaggagcctcacaaattaggtgggcttctgaatgcgctgcaattaacgtccaagtttcaatccttcgaaaaaatgggaaaacagaatggttttttattctatgtcccggcttggaacacaagtaaaattgatcctgttaccggcttcgtgaatttgttcgatacccgctacgcgagcgtagaaaaatctaaagcatttttcaccaaatttcagagtatctgctataatgaggcaaaggattattttgaattggttttcgactataatgattttacagaaaaagctaaagagactcgttctgagtggaccttgtgtacgtatggtgaacgtatcgtaagcttccgcaacgctgaaaaaaatcaccagtgggactctaaaacgattcatttgacaaccgagtttaaaaaccttttcggagaattgcacggtaacgacgttaaggaatatatcttagaacaaaattcggtcgaatttttcaagtcccttatctatcttttgaaaatcactcttcagatgcgcaattcgatcacagggaccgatatcgattatcttgtttcacctgtggctgacgaagcaggcaacttttacgacagccgcaaggccgacactagcttaccgaaagacgcagatgctaacggcgcctacaatatcgctcgcaaaggtcttatgcttatgcatcgcattcaaaacgctgaggacttaaagaaggttaatttagcgatttctaatcgtgactggttgcgtaacgcgcaagggctggacaagtga

SEQ ID NO: 11 - DNA, 3759 bp, Prevotella ruminicola
atgatcgacttaaaacaatttattggcatatatcctgtatcaaagaccttgcgctttgagttgagacctgttggtaagacacaagagtggatagaaaagaatagagttcttgaaggagatgaacagaaggccgcagattaccctgtggttaagaaacttatagatgattaccataaagtatgcattcacgactccttaaatcacgttcacttcgattgggagcctttgaaagatgctatcgaaattttccagaaaacaaagagtgacgaggctaagaaacgacttgaggcagagcaggctatgatgcgtaaaaagatagctgctgcaatcaaggactttaagcatttcaaggagttgacagcggcaactcccagcgatttgattacctctgttcttcctgaattcagcgatgatgggtcgttaaaatcctttcgcggttttgcaacctatttcagtgggttccaagagaatagaaataatatttatagtcaggaggctattagtacgggagtaccttatagactggttcatgataactttcctaagttcctttctgatttggaagtgtttgaaaggatcaagagcacttgtccagaagttatcaatcaggcatcagcagagttacagcccttcttagaaggagtgatgatagacgacattttctcgctcgacttctataattctctgttgactcagaatggtatagatttctttaatcaagtaataggcggcgtaagcgagaaggacaagcagaagtatcgtggtattaacgagttctcaaacctttatcgtcaacagcataaagaaattgcagcatcgaagaaggctatgacaatgataccattattcaagcagatattatctgatcgtgatactttatcttatattcctgctcagataagaacagaagacgaattggtatcttctatcactcagttctatgaccatatcacccatttcgagcatgatggaaaaaccatcaatgtgttatcagaaatagtggctctgttgggtaagttggatacttacgatcctaatggtatttgtataaccgcccgcaagttgacagatatttcacaaaaggtatatggaaagtggagtgttatcgaggaaaaaatgaaagagaaggctatccagcagtatggcgatatatctgtagccaagaataagaaaaaggtagatgcttttctttcgcgtaaggcctatagcttgtctgatttgtgctttgatgaagaaattagtttctcacgctattactctgaattaccccaaactttaaatgcaattagcggctattggctgcagtttaacgagtggtgtaagagtgatgaaaagcagaagttcctgaacaaccaaacaggcacggaggtggtgaaaagtcttttggatgccatgatggaattattccataagtgctctgtcctggtaatgccggaagagtacgaggtagacaagagtttctataatgaattcctccctctctatgaagaacttgatacgctcttcctgttatataacaaggtgagaaattatctcactcaaaagccatccgacgttaagaagtttaagttgaattttgagtcgccttcattggctagtggatgggaccagaataaggaaatgaagaataatgcgattcttcttttcaaagatggtaagtcgtatttaggcgtattaaatgcaaagaataaagccaagataaaagatgctaagggcgatgtgtcgtcttcttcctataaaaagatgatttacaagcttctatctgatccttcaaaggatttacctcataaaatattcgcaaaaggaaatcttgatttctacaagccttcagagtatattttagaaggaagagagttgggtaaatacaagaaaggtccaaactttgacaagaagttccttcatgactttatcgatttctacaaggccgcaattagtattgatccagattggagcaaattcaacttccagtattcccctacagaatcatacgatgatattggcatgttctttagcgaaatcaagaagcaggcttacaagattcgttttactgatatctcagaagctcaggtgaacgagtgggttgataatggccagttatatctgttccagctctataataaggactatgccgaaggtgcgcatggccgtaagaatctgcatacactctactgggagaatctgtttacagacgagaacctcagcaacctagtgcttaaattgaatggtcaggctgaattgttctgtcgtcctcaaagtatcaagaaacctgtttcacacaagattggttcgaagatgctgaatcgcagggataagagcggaatgcccataccagaatctatttatcgcagcctgtatcagtattataatggcaagaaaaaggaaagtgaactgacagttgctgaaaaacagtatatagatcaggtgattgtgaaggatgtcactcacgaaattatcaaagaccgcagatataccagacaggagtacttcttccatgtgccactgacattcaatgccaatgctgatggtaatgagtatatcaacgaacatgtactgaactatctgaaagataatcctgacgtaaatattataggtatcgaccgtggtgagcgtcatctgatttaccttacattgatcaatcagcgtggagaaattctaaagcagaagacttttaacgtggtgaatagctataactatcaggctaagttggaacaacgagaaaaggaacgtgatgaggctcgtaagagttgggatagtgtaggtaagataaaagacctgaaagagggtttcctctctgccgttatccatgagataaccaatatgatgattgaaaacaatgccatcgtggtgcttgaggacttgaatttcggattcaaacgtggacgcttcaaggtggagcgccaggtgtatcagaagtttgagaagatgctgattgataaactgaattatctgtcattcaaggatcgcgaggctggcgaagagggtggtatactcagaggctaccagatggcacagaagtttataagtttccagcgtcttggtaagcagagtggcttcttgttctacatcccagctgcttatacctcaaagatagatcctgtatcaggtttcgttaatcatttcaacttcagcgatatcactaatgccgagaagcgtaaggacttcttgatgaagatggatcgcattgagatgaagaatggaaatattgaatttacattcgactatcgcaagtttaagacattccagactgactatcagaacgtttggactgttagcactttcggaaagcgaattgtgatgcgaatagacgaaaaaggatataaaaagatggtagattacgaaccaacaaacgatattatcaaagcttttaagaataaaggcatcctgttgtcggaaggttctgatttaaaagctctgattgcagagattgaagccaacgcaactaatgccggcttctatagcacactgctctatgctttccaaaaaactctgcagatgcgtaatagtaatgctgtaacggaagaagattatatcctctctcctgtagctaaagatggacatcaattctgtagtactgatgaggcaaacaagggcaaagatgctcaaggcaactgggtatcaaaactgcctgtagatgctgatgctaatggtgcatatcacatcgctttaaagggactttatttgctcagaaatcctgaaacaaagaaaatagaaaacgaaaaatggctccagtttatggttgagaaaccgtatttggagtaa

SEQ ID NO: 12 - DNA, 3759 bp, Artificial Sequence
  Description of Artificial Sequence: Synthetic polynucleotide
atgattgatttaaagcaattcatcggaatctatccagtgtccaagaccttgcgttttgaattacgccctgtagggaagacccaagagtggatcgagaagaatcgtgtgttggaaggcgacgagcaaaaagctgcagattatccggtagtaaaaaaattaatcgatgactaccataaagtttgcattcatgacagccttaatcatgtgcacttcgattgggagccgttgaaggatgccatcgaaatcttccaaaaaacgaaaagcgacgaggccaaaaagcgtttagaggccgagcaagcaatgatgcgtaaaaaaatcgcggctgcaattaaggattttaagcactttaaagaattaactgcagcaacgccttcggatcttatcacctcggtgttaccagagttttcagacgatggaagtttaaagtcatttcgtgggttcgctacatacttttcgggctttcaggaaaatcgtaacaatatttacagtcaggaagcaatctcaactggagttccgtaccgtttagtgcatgacaactttccaaagttcctgtccgacctggaagtctttgagcgcatcaagtcaacttgtccggaagttattaaccaggccagtgcggaattacaaccgttcttggaaggggttatgattgatgatattttcagtcttgatttctataacagcttattgacccagaatggcattgatttctttaatcaagtcatcggaggtgttagcgaaaaagataaacaaaagtaccgtggaattaacgaattctcaaacttatatcgccagcaacacaaagagattgcagctagtaagaaggctatgactatgatccccctgttcaagcaaattttgtccgatcgtgacacgttgtcgtacattcctgcccagatccgcaccgaagacgagcttgtgtctagcatcacgcaattttacgaccacatcacccatttcgaacatgacgggaagaccattaacgtgttgtcagagattgttgcacttcttgggaaactggatacatacgaccctaatggtatctgtatcactgcccgcaagttgaccgatatctcgcagaaggtctacggtaaatggtctgtcattgaggaaaagatgaaagaaaaagcgattcaacagtacggtgacatttccgtggcgaaaaataaaaaaaaagtcgacgccttcttatcacgcaaagcttactctctgtctgatttatgcttcgatgaggaaatctcgttctcacgttattactcggagttaccccaaacgcttaacgctatctcgggatactggctgcagtttaatgagtggtgtaagtccgacgaaaagcaaaaatttttaaataatcagacagggactgaagtagtgaagtcccttttggacgcaatgatggagttgtttcacaagtgctcagtcttggtaatgccagaagaatacgaggtcgacaaatcattctacaatgagtttttacccctttacgaagaactggacactttattcctgttgtataataaggttcgcaattacctgacacagaaaccgtctgacgtgaaaaaattcaaattgaactttgagagtccaagtttggctagcggatgggaccagaataaggagatgaagaataatgcgattttgttattcaaggatggaaagtcgtatcttggtgtcttaaatgctaaaaataaggccaagattaaagacgccaagggggacgtttctagttcctcatacaaaaagatgatttacaaacttctgtctgatccgagtaaggatctgccccataagattttcgccaaaggcaatctggacttttacaagccaagtgagtatattttagagggacgcgagttaggtaaatataaaaaaggacccaacttcgataaaaagttccttcatgatttcatcgacttctacaaagcagccatctcgatcgacccggattggagcaaattcaactttcaatactcgcctaccgaatcctatgatgacattggcatgtttttctccgaaatcaagaaacaagcttacaaaattcgctttacggacatttcagaagcacaggttaatgaatgggtagacaacggtcagttgtatttattccaattgtataataaagattatgcggagggtgctcatgggcgtaagaaccttcatacattgtattgggagaatctgttcacagacgagaatcttagcaatttggtgttgaagttgaatggccaagctgagttgttttgtcgtccccaaagcattaaaaaaccagtttcgcacaagattggatcgaaaatgcttaaccgtcgcgataagtccggaatgcctatcccggaaagcatttatcgctccctttaccaatactacaatggcaaaaaaaaagagtcggaacttaccgtcgctgaaaagcaatacattgaccaggtaatcgtaaaggatgtgacgcacgaaatcatcaaagaccgccgttatacgcgtcaagagtacttctttcacgtaccattaaccttcaatgccaacgcggatgggaatgagtatattaatgagcatgtgcttaactaccttaaggacaacccggacgtaaacatcattggaattgaccgtggggaacgtcatttaatttatttaaccttgattaatcaacgtggggagatcctgaaacagaagacgttcaacgttgtcaatagctacaattatcaagcaaaactggagcagcgtgagaaagagcgtgacgaggctcgcaagtcgtgggattcagtcggcaagattaaagacttaaaagagggatttttgtcagccgtaattcacgaaattaccaacatgatgatcgaaaataatgccattgtcgtgcttgaggatttgaacttcggtttcaagcgcggacgtttcaaagtagaacgtcaggtgtatcaaaagtttgaaaaaatgctgatcgataaactgaattatttatcgttcaaagaccgcgaagcgggagaagaaggtggaattctgcgcggatatcagatggcccagaaattcattagttttcaacgcttagggaagcaatctggctttctgttttacatcccagcggcctacacatctaaaatcgatcccgtatccgggttcgtcaaccattttaatttttccgacatcacgaacgcggagaagcgcaaggacttcctgatgaaaatggatcgtatcgaaatgaaaaatggaaatatcgagttcacctttgattatcgcaagttcaaaacctttcagacagattaccaaaacgtatggacagtcagtacctttggaaaacgtatcgtcatgcgcatcgatgaaaagggatataagaagatggttgattatgaaccgacgaatgatatcatcaaagcatttaaaaacaaaggcatcttactttcagagggttccgacttaaaggcactgatcgctgaaattgaggccaacgccacaaacgcgggtttttattccacattactgtatgcgttccaaaaaacgcttcagatgcgcaactcgaatgcagttaccgaggaggattacatcctttctcccgtggctaaagacggccaccagttttgtagcacggatgaagccaataagggcaaagacgcccagggaaactgggtatcaaaacttccagtagatgccgatgctaacggcgcgtatcatattgcactgaagggattatatttgttgcgcaacccagaaaccaaaaagatcgaaaatgagaagtggttgcagttcatggtggaaaagccctatttggagtaa

SEQ ID NO: 13 - DNA, 3759 bp, Artificial Sequence
  Description of Artificial Sequence: Synthetic polynucleotide
atgattgatctgaagcaattcattgggatttacccggtgtcaaaaacgctgcgttttgagcttcgcccggtcggtaaaacacaggagtggatcgagaaaaatcgtgttttagaaggagacgagcaaaaagccgcagattaccccgtagtcaagaagcttattgatgattaccacaaggtctgtatccacgacagccttaatcatgtccactttgactgggagcccctgaaggacgctattgaaatctttcaaaaaaccaagagcgacgaagccaagaagcgccttgaagcggagcaggctatgatgcgcaaaaagattgctgcggcgattaaggatttcaagcatttcaaagagctgaccgcggctactcctagcgatctgatcacctctgtactgcctgaattctcagacgatggctcattaaagtcctttcgtggcttcgctacttacttcagtggatttcaagagaaccgtaacaacatctactcgcaggaggccatttctaccggggtgccttatcgtcttgttcacgataatttcccaaaatttctgtcggatttagaggtttttgaacgtatcaaaagtacgtgcccagaggtgattaaccaagcttctgcggaactgcaacctttccttgagggcgtcatgatcgatgatattttcagcttagacttctataactcactgttaacacagaatggaatcgacttctttaaccaagtgattggtggcgtctcagaaaaggacaaacaaaaatatcgcggtattaatgagtttagtaatttgtaccgccagcagcacaaagaaatcgctgcgtctaaaaaagccatgacgatgattccgttgttcaaacaaatcctgtctgatcgtgacactttatcttatatcccagcgcaaattcgcactgaggacgaattggtcagctccatcacgcagttctacgatcatatcacacacttcgaacatgacggtaagaccatcaatgtgttgtccgaaatcgtggctttgctgggtaagctggacacctacgaccctaatggcatctgcattacagctcgtaagctgaccgacatttctcaaaaggtctacggtaagtggagtgtcatcgaggaaaaaatgaaggaaaaagccattcagcagtatggtgatatttctgtggctaaaaacaagaagaaagtcgatgcctttctgtcacgtaaggcttactctttgtccgatctttgcttcgacgaggaaatttcattctcgcgctactattccgaattacctcagaccctgaatgcaatttccggctattggttacagttcaatgagtggtgcaaaagtgacgaaaaacagaagtttttaaacaatcagacagggacggaagtggtcaagtccttgttagatgcaatgatggagttgtttcataagtgttctgtgttggttatgccggaagagtatgaggttgataaatccttttacaatgagttccttccgctgtacgaggagctggacacgttgtttctgttatataacaaggtacgcaactaccttactcaaaagccgtccgatgttaagaagttcaagctgaatttcgaatcaccttcccttgctagtggatgggaccagaacaaggagatgaaaaataatgccatcttattatttaaggacggtaagtcttacttgggagtgcttaatgctaaaaacaaagcgaagattaaggacgcgaagggggatgtctcatcaagctcttacaagaaaatgatttacaagttactgtccgacccaagcaaagatcttccccataagatcttcgcaaaaggaaatttagatttttataagccgtcagagtacattcttgaagggcgcgagctgggaaagtataagaaggggccgaattttgacaaaaagtttcttcatgatttcattgacttctacaaagcggcaatctccattgatcctgactggagcaaatttaacttccagtactctcctacagaaagttatgacgacattgggatgttcttctcagaaattaaaaaacaggcatataaaatccgttttacagacatttcagaggcacaggttaatgagtgggtcgataatggccaattgtacttgtttcaactttacaataaagattatgcagaaggtgcacacggccgcaagaaccttcatacgctgtactgggagaatctttttacagatgaaaacttgtcaaatcttgtccttaaattaaacggacaagctgagttgttctgtcgtcctcagtccatcaaaaaaccagtctcacataagatcggatcgaagatgttaaatcgccgtgataaatccggcatgccgatccctgagtcgatttaccgctccttgtatcagtattataacggtaaaaaaaaggagtcagagttaacagttgcagagaagcaatatatcgatcaagtcattgtcaaagacgtgacacacgagatcatcaaagaccgccgctatacgcgtcaggaatatttctttcatgtccctttgacctttaacgccaatgcggacggaaacgagtatattaacgagcacgtcctgaattatttaaaagacaacccagatgtcaacattatcgggattgaccgcggagagcgccacctgatttatttaactcttatcaatcaacgcggtgagattctgaagcagaagacgtttaatgttgtgaatagctataattatcaggcaaaattggaacagcgcgagaaggaacgtgacgaggctcgtaagagttgggactcggtaggaaagattaaagatttgaaagaaggctttttatctgcagtgattcatgagattacgaacatgatgattgagaataatgctatcgttgttttagaagacttaaattttggatttaagcgtgggcgtttcaaggtcgagcgccaagtttatcagaaatttgaaaagatgttaattgacaagttgaactacctttccttcaaagatcgtgaagcaggtgaggagggtggcattttacgcgggtatcagatggctcagaagttcatctctttccaacgcttggggaaacaaagcgggttcttgttctatattccggcagcttacacatctaagattgatccggtatctggtttcgtaaaccattttaactttagtgatattactaatgccgagaaacgtaaagactttcttatgaaaatggatcgcatcgagatgaagaatggtaatattgagttcacctttgactaccgcaagttcaagacgtttcagacggattatcaaaatgtctggactgttagtacatttggcaaacgtattgtaatgcgcatcgacgagaaggggtataagaagatggtggattatgagccgacaaatgacatcatcaaggcttttaaaaacaaaggcattcttttgtctgaaggatccgatttgaaagcattaatcgccgaaatcgaagcaaatgccaccaatgcgggattctactccacattattgtatgccttccaaaaaacattacagatgcgtaactcgaatgcagtaacggaagaagactatattcttagtcccgtagccaaggacggacaccaattttgcagcaccgatgaggctaacaaaggtaaggacgcgcaagggaactgggtcagtaagttaccggtggatgccgacgctaatggagcgtatcatattgctttaaaaggattatacttgttacgcaatcccgaaaccaagaaaattgaaaacgaaaaatggttacagttcatggtagagaagccgtaccttgagtaa

SEQ ID NO: 14 - DNA, 3759 bp, Artificial Sequence
  Description of Artificial Sequence: Synthetic polynucleotide
atgatcgaccttaaacagtttattggtatttatccggtgtcgaaaacgcttcgttttgagttgcgtcctgttggtaaaactcaagaatggattgagaagaaccgcgttttagagggtgatgaacaaaaggcggccgattatcctgtagtaaagaaactgatcgatgactatcacaaggtgtgtattcatgacagtttaaaccatgtacatttcgattgggagcctttgaaagatgcgattgagattttccagaagacaaagtcagacgaggcgaagaaacgcttggaagcagagcaggctatgatgcgcaagaagatcgccgccgcgattaaagactttaaacattttaaagagttaactgctgctaccccttccgatctgatcacgtcagtgttgcccgaattttctgacgacggatccttgaaatcgtttcgcggttttgcaacatatttctctggcttccaggaaaatcgtaacaatatttattcccaagaagctatctcaacgggtgttccttatcgtcttgtccatgacaactttccaaagtttctgagtgatttagaagtgttcgagcgcatcaagtcaacgtgcccagaagtgatcaaccaggcctccgcggagttgcaaccattcttagagggagtaatgattgacgatattttctcattagacttctataattcgctgttgacccaaaatggcatcgacttcttcaaccaggtcatcggaggtgtgagtgaaaaagacaagcagaagtatcgtggaattaatgagttctcaaatctgtatcgccagcaacacaaagagattgccgcaagtaagaaggctatgacaatgatccccttgtttaagcagatcttatccgaccgtgacacactttcttacattcctgcccaaattcgtacagaagacgaattggtatctagcatcacgcaattctacgaccacatcactcacttcgaacacgacggtaaaacgatcaatgtattaagtgagatcgttgcgctgttgggaaaacttgacacttacgaccctaacggcatttgcattacggcacgtaaacttaccgacatctcgcaaaaggtgtatgggaaatggtccgtcatcgaggaaaaaatgaaggaaaaggcgattcagcagtatggagacatctctgtggctaagaataagaaaaaggttgacgcttttttgtcccgcaaggcgtactcgttgtctgatctgtgtttcgatgaagagatctccttctcacgttattattcggagctgccccaaacgttgaatgcaatttctgggtattggttgcagttcaacgagtggtgtaagagcgacgaaaagcagaaatttcttaacaatcagacaggtactgaggtcgttaaaagcttattagacgcgatgatggaactgttccacaaatgttcggtcttagtaatgcctgaggaatatgaggtagacaaatcattttataatgaatttcttcctctttatgaagaattggataccttatttttgctgtataataaagttcgtaattacctgacgcagaagccctctgacgtaaagaaattcaaattgaattttgaatcgccttccttagcatcggggtgggatcaaaataaagaaatgaaaaacaacgcaatcttattatttaaagacggaaagtcatacttgggcgtgttaaacgccaagaataaggccaaaattaaagatgcaaagggcgatgtctcatcgtcgtcctacaagaagatgatttataaacttctttctgatcctagcaaggatttaccgcataaaattttcgcaaaggggaacttagatttctataaaccctcggaatatattttggaaggccgtgagttgggtaaatataaaaagggacccaattttgataaaaaattcctgcatgatttcatcgacttctacaaggcagctatttccatcgacccagactggtccaaattcaacttccaatactcgccaacggagtcttacgacgatatcgggatgtttttctcggagattaagaaacaggcctataagatccgctttacggatatttccgaagcacaagttaatgagtgggtggacaacgggcagctttatcttttccagttatacaacaaggactacgcggaaggggcccacggccgtaagaacttgcatactttatattgggagaatttgtttaccgatgagaacctgagtaatttggtactgaagctgaatggccaagcagaactgttttgccgtccgcaaagtattaagaagccagtgtcgcacaaaattggatctaagatgctgaatcgtcgcgataagtcaggaatgcctattccagagtccatctatcgttcgctttaccagtactacaatggcaaaaagaaagagtctgaattaaccgtggcggaaaagcagtatattgatcaagtaattgttaaggatgttacacacgagattattaaggatcgccgctacacacgtcaggaatatttctttcatgtcccacttacgttcaatgctaacgcagatggcaacgagtatattaacgagcacgtgttgaactatcttaaggataatccggatgtgaacatcattgggattgatcgtggtgagcgtcatttgatctatctgaccttgattaatcaacgtggtgaaatcttgaagcagaagacattcaacgttgttaacagttacaattaccaggcgaaacttgagcagcgtgaaaaggaacgtgacgaggcacgtaagtcgtgggatagtgttggaaagattaaagacttgaaggaaggttttttgtcggcggtaattcacgagatcacgaatatgatgattgagaacaacgcaatcgtagtactggaagatctgaattttgggtttaaacgcgggcgctttaaggtggaacgccaagtgtaccagaaatttgagaagatgcttattgataaactgaactatttatcgtttaaggaccgcgaagctggagaagaaggcggcattctgcgtggataccaaatggcgcaaaaatttatctcgttccagcgtctgggcaaacaatccggcttccttttctacattcccgctgcttacacatcaaagattgaccctgtctcgggtttcgtaaatcattttaacttctcagatattacgaacgctgagaaacgcaaagactttttaatgaagatggaccgcattgaaatgaaaaacggtaatatcgagttcacctttgattaccgcaagttcaagacattccagaccgactaccagaacgtctggacagtatccacttttgggaagcgtattgtaatgcgtatcgacgaaaagggctataaaaaaatggtcgattatgaaccgacaaacgacatcattaaggcttttaagaataagggtattttactgagtgagggctctgatttgaaggctcttattgctgaaattgaggccaacgctacgaacgctggattttatagtacacttctttacgcgttccaaaaaactcttcagatgcgcaacagcaacgcggtgacagaggaagactatattttaagtccggtagcgaaagatggacatcagttctgttctacagacgaggccaataagggaaaggacgctcagggtaattgggtttcgaagctgccggttgacgccgatgctaacggcgcgtatcacatcgctttaaagggattatatcttctgcgtaatcccgagacaaagaagatcgaaaatgaaaaatggttacaatttatggttgaaaaaccttacttggaataa

SEQ ID NO: 15 - DNA, 3864 bp, Clostridium sp.
atgtcgtataatagagaaaaaatggaggagaaagaattgggtaaaaatcaaaattttcaggaatttattggggtatcaccacttcaaaagactttaagaaacgaattgatcccaacagaaacaacaaagaagaatattgctcagcttgatcttttgactgaggatgaagtgcgtgcgcaaaatcgagagaagctgaaagaaatgatggatgactactaccgggatgtgattgatagtacgttacggggggaattattgattgattggagctatttattttcgtgcatgcgaaaccatctaagtgagaattccaaagagtcaaaacgggaattggaacgaacacaggattctgttcgttcacaaatccatgataagtttgctgaacgagcggattttaaggatatgtttggagcatcgataataacaaaattacttccgacatatataaagcaaaattcaaaatattccgagcggtatgacgagagcgtgaaaattatgaaactgtatggaaaattcacaacatcgttgaccgattactttgagacaagaaagaatatcttttctaaagagaaaatatcctctgccgttggatatcgaatcgtagaggaaaatgctgagattttcctgcagaatcagaatgcttacgacagaatctgtaagatagcgggactggatttacatggattggataatgaaataacagcatatgttgatggaaaaacattaaaagaagtatgttccgatgaaggatttgcaaaggtgattacacaaggagggattgatcgctacaacgaggcaattggtgcggtaaatcaatatatgaatctgttatgccagaagaataaggcattaaaaccgggacaatttaagatgaagcggctacataaacagattctttgcaaaggaacaacctctttcgatattccaaagaagtttgaaaatgataaacaggtgtatgacgcagttaattcttttacagagatagtaacgaagaataatgatttgaagcgactgttaaatattacacagaatgcaaatgattatgacatgaataaaatctatgtagtagccgatgcatatagtatgatttcacagtttatcagtaaaaaatggaatctgattgaagaatgcttgctggattattatagcgataatttgccgggaaaaggaaatgcgaaagaaaacaaagttaaaaaggcggtaaaggaagaaacgtatcgcagtgtttcacagttgaatgaagttattgagaaatattatgtggaaaagaccggacagtcagtatggaaagtggaaagttatatttctagtctggcagaaatgattaagctggaattgtgccacgagatagataacgatgagaagcataatctgattgaagatgatgagaagatatccgagattaaggaactgttggatatgtacatggatgtatttcatattataaaagtgttccgggtgaatgaagtattgaatttcgatgaaaccttttattcggagatggatgagatctatcaggatatgcaggaaatcgttccattatacaatcatgttcgaaactatgttacacagaaaccatataagcaggagaaatatcgtttatatttccacactccaacattggcaaatggctggtccaagagtaaggaatatgacaacaacgcaattatattggtgcgagaagataaatattatttaggtattctgaatgcgaaaaagaaaccatcgaaagaaattatggcgggcaaagaggattgttcagaacatgcatatgcaaagatgaattattatttgttgccgggcgcgaacaagatgcttccaaaagtatttttatctaagaaaggaatacaggactatcacccatcatcatatattgttgaaggatataatgaaaagaaacatattaaaggttccaagaattttgatatccggttttgtagggatttgattgactacttcaaggaatgcattaaaaaacatccggattggaataagtttaactttgaattttctgcgacagaaacatatgaggatatcagtgtcttttatcgcgaagttgaaaagcaaggatatcgcgtagagtggacgtatatcaatagtgaagatattcagaaactggaagaagatggacagttgtttttatttcagatatataacaaagattttgctgtgggaagtacaggtaaaccaaatcttcatacattgtatctgaaaaatctgttcagcgaagaaaatttgcgggacattgtattaaaactaaatggggaagcagaaatattcttccgtaaatcaagtgttcaaaaaccggtgattcataagtgcggcagtattttagtcaatcgtacctatgagattaccgagagtggaacaacacgggtacaatcaattccggaaagtgaatacatggaattatatcgctactttaatagtgaaaagcagatagaattatcagatgaggcaaaaaaatatttggacaaggtgcaatgtaataaggcaaagacagatattgtgaaagactaccgatacaccatggacaagttttttattcatcttccgattacgattaattttaaggttgataagggtaacaatgttaatgccattgcacagcaatatattgcagagcaggaagatttgcatgtgataggaatcgatagaggagaacggaatctgatttacgtttctgtaattgacatgtatggcagaattttagagcagaaatcctttaaccttgtggaacaggtatcgtcgcagggaacgaagcgatattacgattacaaagaaaaattacagaaccgggaagaggaacgggataaagcaagaaagagttggaagacaatcggcaagattaaggaattaaaagaggggtatctgtcgtcagtaattcatgagattgcacagatggtcgtaaagtataacgcaatcattgcaatggaagatttgaattatggatttaagcggggaagattcaaagtagagcgccaggtatatcagaaatttgaaacgatgttgatcagtaagttgaattatctggcagataaatctcaggctgtggatgaaccgggaggtatattacggggatatcagatgacttatgtgccggataatattaagaatgttggaagacaatgtggaataatcttttatgtgccggcagcatatacctccaagattgatccgacaaccggatttatcaatgcatttaagcgggatgtggtatcaacaaatgatgcaaaagagaatttcttgatgaagtttgattctattcagtacgatatagaaaaaggcttatttaagttttcatttgattacaaaaattttgccacacataaacttacacttgcgaagacaaaatgggacgtatatacaaatggaactcgaatacaaaacatgaaagttgaaggacattggctttcaatggaagttgaacttacaacgaaaatgaaagagttgctggatgactcgcatattccatatgaagaaggacagaatatattggatgatttgcgggagatgaaagatataacaaccattgtgaatggtatattggaaatcttctggttgacagtccagcttcggaatagcaggatagataatccggattacgatagaattatctcaccggtactgaataatgatggagaattttttgattctgatgaatataattcatatattgatgcgcaaaaggcaccgttaccgatagatgccgatgcaaatggcgcattttgcattgcattaaaaggaatgtatactgccaatcagatcaaagaaaactgggttgaaggggagaaacttccggcggattgcttgaagatcgaacatgcgagttggttagcatttatgcaaggagaaaggggatag

SEQ ID NO: 16 - DNA, 3864 bp, Artificial Sequence
  Description of Artificial Sequence: Synthetic polynucleotide
atgtcgtataaccgtgagaagatggaggaaaaagagctgggtaagaaccaaaatttccaagaatttatcggtgtaagtccactgcaaaagacgcttcgcaatgagttaattccgactgagacaacgaagaaaaatattgctcaacttgacttactgactgaggacgaggtccgtgcgcagaaccgtgaaaagctgaaagaaatgatggatgactattaccgcgatgtcattgattcaacgcttcgtggcgaattgttaattgattggagttacctgttctcttgcatgcgcaaccatttaagcgaaaactctaaggagtcgaagcgtgaacttgaacgcactcaggacagtgttcgcagtcagatccacgataaattcgcagaacgtgctgatttcaaagatatgttcggagccagtatcattacgaagttacttcctacttatattaagcagaattccaagtacagcgaacgttatgacgaaagcgtaaagatcatgaaattatatggaaagtttacaacgtcactgacggattattttgaaacgcgtaagaatatcttttctaaagaaaaaatcagctctgccgtgggataccgtatcgtggaagagaatgcggaaatctttctgcaaaatcaaaatgcctacgaccgcatttgcaaaatcgccggtcttgacttacatggcctggataacgaaatcacggcttacgttgacggaaaaactttgaaggaagtctgcagcgacgaaggtttcgccaaggtcattacacaagggggtatcgatcgttataatgaagccattggcgccgtcaaccagtacatgaacctgctttgccagaaaaacaaagcgttgaaaccgggacagtttaagatgaagcgtcttcataagcagatcttgtgcaagggcacgacgtcctttgacatccctaaaaagttcgagaatgataagcaagtctatgatgctgttaatagtttcacagagatcgtcactaagaataatgatttaaaacgtcttttgaacatcactcaaaacgctaatgactacgatatgaacaagatttatgtggtcgccgacgcatattcaatgatttctcagtttatctcgaagaaatggaatcttattgaggaatgtttattggactactattcggataacctgccaggtaaagggaatgctaaagagaataaggtcaagaaagctgtaaaggaagaaacctatcgttcggtcagccagcttaacgaggtgattgagaagtattatgttgaaaaaactggtcagtccgtttggaaagtcgagtcgtacatttcgtcgcttgccgaaatgattaagctggagctttgtcatgaaatcgacaatgacgagaagcataacttaatcgaggatgacgagaagatttcagagatcaaggagcttcttgatatgtacatggacgttttccacatcattaaggtatttcgtgtgaacgaagtacttaattttgatgaaactttttactctgaaatggacgagatctaccaagatatgcaggaaattgtgcctttatataatcacgtgcgcaactatgtcacacaaaagccctacaaacaagaaaagtaccgtttgtatttccacacccccacgttagccaacgggtggtccaaatctaaggaatatgataataacgcgatcatcctggtccgtgaagataagtactatttgggaatccttaatgcgaaaaaaaagccgtccaaagaaattatggcagggaaagaagattgctcagaacacgcttacgccaagatgaactactatttattacccggtgcaaataaaatgttgcctaaggtgtttttatccaagaagggtattcaggactaccatccgagctcgtatatcgtagagggctacaacgaaaagaagcacatcaaagggagcaaaaatttcgacattcgtttttgtcgtgatttgatcgactacttcaaagagtgcattaagaaacatccagattggaacaagttcaactttgagttttcagccacagaaacctatgaggacatctccgtgttctatcgcgaagtagaaaagcaaggataccgcgtagagtggacttacattaattccgaggacattcagaaattagaggaggacggccagttgtttctgtttcaaatctacaataaggattttgccgtgggatcgacgggcaaaccaaatttgcacactctgtacttaaagaatcttttctcggaggagaacctgcgtgacattgtacttaaattaaacggagaggccgaaatcttttttcgtaagtcgtctgtccaaaagccggtaatccacaaatgtgggtcgattttggtaaaccgtacatatgaaatcacggaatctggcactacgcgcgtgcaatccattccagagtccgagtatatggaattatatcgttatttcaactcggaaaagcagatcgagctgtctgatgaggccaaaaaatacttggataaagtacaatgcaataaagctaagaccgacattgttaaggactaccgctacacgatggataagttctttattcacttgccaattactattaacttcaaggtagacaaaggaaacaatgtaaacgcgattgcacagcaatatattgcagaacaggaggacctgcacgtcattggtattgaccgtggagagcgtaaccttatctacgtgtccgtcattgacatgtatggacgtatccttgaacaaaaatcatttaaccttgtcgagcaggttagtagccaggggacaaagcgctactatgattacaaagaaaagttgcagaaccgtgaagaagaacgtgacaaagcccgtaaaagttggaagaccattggaaagattaaggaattgaaggaaggttacttaagtagcgtgattcacgagattgcacaaatggtcgtgaaatataacgccattattgcaatggaggatcttaattatggtttcaagcgcggccgtttcaaagtggaacgccaggtctaccaaaagtttgaaactatgttgattagcaaattaaattatcttgctgacaaaagccaagcagtggacgaaccgggaggaatcctgcgtggttaccagatgacatacgtcccagacaacatcaagaacgtagggcgccagtgtgggattattttctacgtccccgccgcttatacatctaagattgaccctacaaccggctttattaacgcctttaagcgtgacgtagtaagcacgaacgatgctaaggagaattttctgatgaagttcgatagcatccaatacgacattgagaagggactttttaagttctcctttgattataagaactttgcaacccacaaacttacccttgcaaaaaccaagtgggacgtatatacgaatggcacgcgtatccagaatatgaaagttgaggggcactggctttctatggaagttgagttaactactaaaatgaaagagttgctggacgactcccacatcccatatgaagaaggtcagaatattctggacgatcttcgtgaaatgaaggatatcacgacgattgtaaatgggattttggagattttttggttaacagttcagttgcgtaacagccgtattgataaccctgactatgatcgcattatttcgccagttttgaacaatgacggtgagttcttcgactcagacgagtataacagttacattgacgcacaaaaggccccccttcctatcgacgcggatgccaatggcgctttctgcattgcactgaaaggaatgtacacggcgaaccaaatcaaggagaattgggtcgagggagagaaattaccagcggactgtcttaagattgagcacgcatcatggttagcctttatgcaaggggaacgtgggtag

SEQ ID NO: 17 - DNA, 3864 bp, Artificial Sequence
  Description of Artificial Sequence: Synthetic polynucleotide
atgagttacaatcgtgaaaaaatggaggagaaggaactgggaaagaatcaaaacttccaggagtttatcggggtctcgcctttgcaaaagaccttacgtaacgaacttattccaaccgagacgacgaagaagaatatcgcacagttagacctgcttaccgaagacgaggtacgcgctcagaatcgcgaaaagttgaaggagatgatggacgattactaccgcgacgtcatcgatagcacattgcgcggcgagttgttaattgactggtcttatttattctcctgcatgcgcaatcacctgtcggagaattctaaggaaagcaagcgtgaattggagcgcacccaagattcagttcgctcacagatccacgacaagttcgccgaacgcgcagattttaaagacatgtttggagcctcgattattacgaaacttctgcctacgtatattaagcaaaattcgaagtactcagagcgctatgacgagagcgtaaaaattatgaagctgtacggtaagtttaccacctcgcttacagactactttgaaacccgtaagaacattttttcaaaggaaaaaatctcgtcggccgtgggatatcgtatcgtcgaagagaatgctgagatctttttacaaaaccaaaacgcttacgaccgcatttgtaagattgcgggtttagatctgcacgggttggataacgagattacagcatatgtggatggaaaaacgcttaaagaggtctgtagcgatgagggattcgccaaagtaattactcaaggtggaatcgaccgctacaacgaggcaatcggagccgttaatcagtacatgaatttactgtgtcaaaaaaacaaagcgcttaaaccggggcagttcaaaatgaagcgccttcacaaacagatcttatgcaagggaaccacgtccttcgacatccctaaaaagtttgagaacgacaaacaggtctatgatgctgtcaactcgttcacagagatcgtaacgaagaacaacgacttaaaacgcttgcttaacatcacccaaaacgcaaacgactatgatatgaacaagatctacgtggttgcagacgcctactctatgatcagccagtttatctcaaagaaatggaacttgatcgaggagtgtttgcttgactattactcagacaaccttcctggtaaaggcaatgccaaagaaaataaggtcaagaaagcggttaaagaagaaacataccgcagcgtgagtcaactgaatgaggtaatcgaaaagtactatgtggagaaaacaggtcaaagcgtctggaaagtggaatcatacatttcttctttagctgagatgattaaattggaactttgtcacgaaatcgataatgacgagaaacacaacttaatcgaagacgacgagaaaatcagtgagattaaggaactgctggatatgtacatggatgtttttcatattatcaaagttttccgcgttaacgaggttttaaactttgacgaaacattttatagcgagatggatgaaatttaccaggacatgcaggaaattgtgccgttatacaatcatgtccgcaactatgttactcagaagccctacaaacaggagaaatatcgcttatatttccacaccccaacacttgctaacggctggtcgaaaagcaaggaatatgacaataacgcaatcatccttgttcgtgaagataaatattatctggggatcctgaatgccaaaaaaaaaccgtcaaaagaaattatggctggaaaggaagactgttcagaacacgcctatgcaaagatgaactactacttgctgcccggagccaataagatgctgccaaaggtatttttgagcaagaaggggatccaagactaccaccccagttcctacatcgtcgaaggctacaacgagaagaaacacatcaaagggagtaagaacttcgacattcgtttctgccgcgacctgatcgattacttcaaggagtgtatcaaaaaacacccagactggaacaaatttaatttcgagttctccgctacggaaacttatgaagatatttcggtcttttaccgcgaagtggagaagcaagggtaccgtgtggagtggacgtatatcaacagtgaggatattcagaagctggaagaagacgggcaactgttcctgtttcagatctataacaaagatttcgccgtggggtcgactgggaagcctaatttacatactctttatttaaaaaatctgttctcggaggagaacttgcgtgatattgttttgaagcttaatggcgaggctgagatctttttccgcaagagttccgttcaaaaacctgtgattcataaatgtggtagcatcttggtaaaccgcacttacgaaatcaccgaaagtggaaccacgcgcgtacagtcaatccctgaatctgagtacatggagctgtatcgctatttcaacagcgagaaacagattgaactgtctgacgaagctaagaaatacttagacaaggttcagtgcaataaggcaaagacagatatcgtaaaagactatcgttataccatggataaatttttcattcatttgcccattactatcaattttaaagtcgacaaaggcaacaatgtcaacgccattgctcaacagtatatcgctgaacaagaggatctgcatgtcatcggcattgatcgtggcgaacgtaatttaatttacgtgagcgttatcgacatgtacgggcgtatcttagaacagaaatcatttaaccttgtagaacaggtgtcaagccagggtacaaaacgctattatgattacaaggagaagcttcaaaaccgcgaagaggagcgcgacaaggctcgtaagtcttggaagactatcggaaaaatcaaagagctgaaggaggggtatctgagctcggtcatccacgagatcgcccagatggtcgttaaatataatgcaattattgcgatggaagaccttaattatggctttaagcgcggacgtttcaaagtggagcgtcaggtgtatcagaagtttgaaaccatgcttatttcgaagttaaattatttggcagacaagtcgcaagcggttgatgagccggggggcatccttcgcggataccagatgacctacgtaccggataatatcaagaatgtggggcgtcaatgtgggatcattttttatgttccggctgcgtacacgtcaaagattgaccctactaccgggtttattaatgctttcaaacgcgatgttgtctccacaaacgacgcaaaggaaaattttttgatgaaatttgactccatccaatacgatatcgaaaaagggcttttcaaatttagcttcgactataaaaattttgcgacccacaaattaacgcttgcaaaaactaagtgggatgtatacacaaacggtactcgtattcaaaatatgaaagtggagggccattggttatctatggaggtcgagcttactactaaaatgaaggaattacttgatgattcgcatatcccatacgaggaaggccaaaacatcctggatgaccttcgtgagatgaaagacattacgacaattgtcaatggtatcttggaaatcttttggcttacggtacagttgcgtaattcacgtatcgacaacccagattacgaccgcattatttctccagtgcttaacaatgatggggaatttttcgattcagatgagtacaacagctatattgacgcccagaaggcaccgcttccgatcgacgcggatgccaacggagccttctgtattgctttgaagggtatgtatactgccaaccaaatcaaagagaactgggtcgaaggtgagaaattaccagctgattgtctgaaaatcgaacatgcctcttggttggccttcatgcaaggggaacgtggatag

SEQ ID NO: 18 - DNA, 3864 bp, Artificial Sequence
  Description of Artificial Sequence: Synthetic polynucleotide
atgagctacaaccgcgagaagatggaagaaaaggaattaggaaagaatcagaatttccaggaatttattggagttagcccattgcagaaaactttgcgtaacgaactgattcccactgaaactactaagaagaacatcgcccaattagatctgcttaccgaagacgaggtccgcgcacagaatcgcgaaaagttaaaagaaatgatggatgactattatcgcgatgttattgactcaacattgcgtggtgagttacttattgactggtcatacttattttcgtgcatgcgcaatcacctttcggaaaattccaaggagagtaagcgtgaattggaacgtactcaagattctgtccgtagtcagatccacgacaagtttgctgaacgtgctgattttaaggacatgtttggggcatccattattacgaaattacttccaacttacatcaaacaaaattcgaagtactctgagcgctatgatgaaagtgtgaagattatgaaactttacggtaaatttacaacctcacttacggattactttgagacacgtaagaatatctttagcaaagagaagatctcatcagcggtcggttatcgcatcgtcgaggagaacgcggagatctttttacaaaaccaaaacgcttacgatcgcatttgtaaaattgcggggctggacctgcacggacttgacaatgagatcacagcatacgtggatggaaaaacccttaaggaagtttgcagtgacgagggcttcgcgaaggtaatcactcaggggggaatcgaccgctataatgaagcaatcggtgccgtgaaccaatacatgaacctgttgtgccaaaagaataaagctcttaaaccaggtcaatttaaaatgaaacgtcttcataagcaaatcttatgtaaaggcacgacgagcttcgacatccctaagaagttcgaaaatgataagcaggtttatgacgccgtaaactcgtttactgaaatcgttacgaaaaataatgacttaaagcgtttgcttaacatcacgcaaaacgcgaacgattacgacatgaataaaatctacgtcgtcgcagatgcgtattctatgatctcccagtttatctctaagaaatggaatttgatcgaggagtgcctgctggattactattctgacaatcttccgggcaaaggaaacgctaaagaaaataaggtcaagaaggcagtgaaagaggagacatatcgtagtgttagtcagttgaacgaggtcattgaaaagtattacgttgagaagaccggtcagtcggtgtggaaggtggagtcgtatatttcgtcactggctgaaatgattaagttagaattatgtcatgagattgacaatgatgaaaaacataatcttattgaggatgacgaaaagatttctgaaatcaaggaactgctggacatgtacatggatgtgttccacattatcaaggtatttcgcgttaatgaagtcttgaacttcgatgaaacgttctatagcgagatggatgagatttatcaggatatgcaagaaattgtccctttatataaccatgtccgtaactatgttactcagaagccatataagcaagaaaaataccgcctttactttcacacgccaactttagcgaacgggtggagcaaatcaaaggagtatgataataacgccatcatcttggttcgtgaagacaaatattatttaggaattcttaacgccaagaagaaaccatcaaaagagatcatggcagggaaggaagactgttcagagcacgcttacgccaaaatgaactactaccttcttccgggtgcaaataagatgttgccaaaagttttcttgtccaaaaaagggattcaagattaccatcccagttcttacattgtggagggatacaatgagaaaaagcacattaagggctctaagaactttgacatccgtttttgtcgcgacttaattgactattttaaagaatgtattaagaaacatcccgattggaacaaatttaatttcgaattcagcgcgacggaaacctatgaagacattagtgtattttatcgcgaagtggaaaaacaaggttaccgcgttgagtggacctacattaacagcgaggacattcagaaattggaggaggatgggcaactgttcttgtttcaaatctacaacaaagatttcgctgtcgggtccactgggaaaccgaacctgcatacgctttatttgaagaacttattttcggaagagaatcttcgtgacattgttctgaaacttaacggggaagcagagattttttttcgcaagtcgtccgtccaaaaacccgtaattcataaatgtgggagcattttagtaaaccgcacatatgagatcactgaaagcggaactactcgtgttcagtcgattcctgagtctgagtatatggagttgtaccgctatttcaattctgagaaacaaattgagctgtccgacgaggcgaagaagtacttagataaggtacagtgtaataaggcaaagacagacatcgtgaaggactaccgttatacgatggacaaattcttcattcatctgccaattactattaatttcaaggttgataaaggcaacaatgtgaacgcaatcgcacagcagtatattgctgagcaggaagacttgcacgtcatcgggatcgaccgtggagaacgtaaccttatctatgttagtgtcattgacatgtacggacgcattctggagcagaagtcattcaacttggtagaacaggtatcgagccaaggcacgaagcgttattacgattacaaggagaaactgcagaaccgcgaggaagaacgtgacaaggcccgcaaaagctggaaaacaattggcaaaattaaagaattaaaagaagggtaccttagttcagtcatccatgagattgcccagatggtggtcaagtataacgcaatcattgcaatggaagatctgaattatggcttcaagcgtggtcgctttaaggtcgaacgccaagtctatcagaaattcgagaccatgcttatcagcaaacttaactacttagcagacaaatcgcaggcagtagacgaacctggcgggatccttcgcggctaccaaatgacgtatgtacctgacaatatcaaaaacgtcggtcgccaatgtgggattattttttacgtaccggcggcctacacgtcaaaaattgatcctacaacggggtttatcaacgcatttaaacgcgatgtggtttcgacaaacgatgcgaaggagaactttctgatgaaatttgactcgatccagtacgatattgaaaagggcctgttcaaattctcgttcgactacaaaaatttcgcgactcataaactgacgctggccaagacgaagtgggatgtctacacgaatgggacacgtattcagaatatgaaggtggaaggacattggttgtcaatggaggtcgagcttacgacgaaaatgaaggagcttctggatgacagccacattccctacgaggagggccaaaatatcttagatgatttgcgcgagatgaaagacatcacaaccattgttaatggaatccttgagattttctggctgaccgtacaattacgtaattcacgcatcgacaacccggattatgatcgcattatttctccagtgctgaataacgatggcgagttctttgattctgacgaatacaattcttatattgacgcacagaaagcgcctttacctatcgacgcagatgccaatggcgcattttgcattgcactgaagggcatgtatacagctaaccaaattaaagagaactgggttgaaggtgagaaattaccagctgattgcttaaagatcgagcacgcatcttggttggcatttatgcagggggaacgcggatag

SEQ ID NO: 19 - DNA, 3888 bp, Limihaloglobus sp.
atgagtgcagtatttaaaatcaaggagagtaccatgaaggactttacacatcagtattcactgagcaagacattgaggtttgagctcaaacccgtcggagaaacggcagagaggatcgaggatttcaaaaatcaggggctcaaaagtattgttgaagaagaccgccaacgagcagaagattataaaaagatgaaaaggattctcgacgattatcacaaagaatttatcgaagaggtgctcaatgacgacatcttcaccgcaaacgaaatggaatctgctttcgaagtgtaccgcaaatatatggcgagtaaaaatgatgataagctgaaaaaagaaatcaccgaaatttttacagatttaagaaagaaaatcgcaaaggcttttgagaataagagcaaagaatattgtctttacaaaggcgacttcagcaaactgataaacgaaaagaagaccggaaaagacaaagggccgggaaaactctggtactggcttaaagctaaggcagatgcaggagttaacgaattcggagacggccaaacttttgaacaagccgaagaagccttagccaaattcaataatttcagcacctatttcaccggattcaaccagaatcgtgacaatatctacacggatgctgaacagcaaaccgctatcagctacagagtaataaacgaaaatatgaccagatattttgacaactgcattcgatactccagtattgaaaacaaatatccggaactcgtaaaacagcttgagccgcttagcggcaaattcgcccccggaaactataaagattatctaagccagactgccatcgatatttacaacgaagctgtcggccataagtctgatgacataaacgcaaagggtatcaaccagttcatcaatgaataccgacagagaaacagcataaagggccgcgagctgccgattatgtccgtactctacaaacagatattaagcgatattaataaagatctcattatcgacaagttcgagaacgccggcgagcttttggatgctgtaaaaacactccacagagaattaactgataaaaagattttgctcaagattaaacaaactcttaacgaatttctcacagaagacaattcggaggatatttacatcaaaagcggcaccgatcttacagcagtttcaaacgctatatggggcgagtggtctgttattcctaaagcactcgaaatgtacgccgaaaacataactgacatgaatgctaaagccagagaaaaatggctgaaacgagaagcctaccatttgaaaaccgtacaggaagcgatagaagcgtacctgaaagataacgaagaatttgaaacccggaatatatcagaatatttcacaaattttaaatccggcgaaaacgaccttattcaagttgtccaaagtgcttacgcgaaaatggaatcgattttcggtatagaggattttcacaaagacaggcgtcccgtcacagaaagcggcgagcccggagaaggtttcagacaggtagaacttgttcgggagtatcttgacagcctgataaacgtagaacactttataaaaccgctgcacatgttcagaagcggtaagccgattgagctggaagactgcaacagcaacttctacgatcctttgaatgaggcatataaggaactcgatgttgtattcggcatatacaacaaagtaagaaattacgttacccaaaaaccctattcaaaggataaatttaaaatcaattttcaaaacagcacccttctcgacggctgggatgtaaacaaagaatcagccaacagctctgttttgctgttaaaaaatggcaaatattaccttggtgtaatgaagcagggcgcaagcaatatcctcaattaccgcccagagccgagcgatagcaaaaacaaaataaacgccaaaaaacagctttcagaaatagcacttgcaggggcaacggatgattattacgagaaaatgatatataaactgttgcctgaccctgctaaaatgctgccaaaagtgtttttcagcgccaaaaacattgaattttacaacccttcccaggaaataatatatatcagggaaaatgggcttttcaagaaagacgccggcgataaagagtcccttaaaaagtggatcggtttcatgaaaacatcgcttttaaaacaccctgaatggggtagttactttaactttgaatttgagcccgctgaagattatcaggatatcagtattttttacaaacaagttgcagagcagggctactctgttacttttgacaaaataaaaacaagttacatagaagaaaaggttgccagtggagagctgtatctctttgaaatatataataaggatttttctccacacagcaagggacggcccaatctgcatacaatgtactggaaaagtctttttgaaaaagagaatctccaaaatctcgtaactaaactcaacggcgaggcggaggtcttcttccggcagcattccataaagagaaacgagaaggtggttcacagagccaaccggccgatacaaaacaaaaaccccctcaccgaaaagaaacaaagcatctttgaatacgacctcgtgaaagaccgccggtttacaaaggataaattttttctgcattgccctattacgctgaacttcaaagaggccggacccggcaggttcaacgacaaagtcaacaaatatatcgccggcaatccggacatcaggataataggcattgacagaggagagaggcacctgctctattacagcctcatagaccagagcggcagaatcgtggagcagggcacacttaaccagataaccagtaccctcaacagcggcggcagggaaatacccaaaaccaccgattaccgcggcctgcttgatacaaaagaaaaagaacgggacaaggcgagaaaatcatggtcaatgattgaaaacattaaagagctcaaaagcggctatctctcgcatattgtccataaactcgctaaactgatggttaagaataatgcagttgtggtgcttgaggatcttaatttcgggttcaaacgcggccgattcaaggttgaaaaacaggtttaccagaaatttgaaaaggccctcatagaaaagctgaactatcttgttttcaaagacgcccggcccgcagagccggggcattatctcaacgcataccagcttaccgcacctcttgaaagttttaaaaagctcggcaaacagagcggatttatatactatgtgccggcgtggaacacctcaaagattgaccctgttaccggttttgtaaatcagttttacatcgaaaagaactcaatgcagtaccttaaaaacttttttggtaaattcgattcgataaggtttaacccggataaaaattacttcgagtttggatttgactacaaaaactttcataacaaggccgccaaaagcaaatggactatctgcacccatggagacaaacgctcatggtacaaccgtaaacagagaaaactggagattcacaatgtaacagaaaatctggcaagcctgctcagcggcaaaggcataaatttcgctgacggcggcagtatcaaagacaaaatactatccgtagatgatgcgtctttctttaaaagccttgcatttaattttaaactcaccgcccagcttaggcacacattcgaggataacggcgaggagatcgactgcattatctcacctgtcgcggcggctgacggtacattcttctgttctgaaacggcaaaaaaacttaacatggaattaccccatgacgccgacgcaaacggtgcttataatattgcccgtaagggtcttatggttctaaggcagatacgcgaaagcggcaagcccaagccaatctcaaacgccgattggttagacttcgcccagcagaatgaagattga

SEQ ID NO: 20 - DNA, 3888 bp, Artificial Sequence
  Description of Artificial Sequence: Synthetic polynucleotide
atgtctgctgtattcaaaatcaaggagtctacaatgaaggattttactcaccaatacagtctgagcaagacacttcgcttcgagctgaaaccagttggggaaaccgcagagcgcattgaggacttcaaaaaccaaggattaaagtccattgtagaagaagaccgccagcgtgctgaagattataaaaagatgaaacgtattctggatgactatcacaaagagttcattgaggaggtgttaaacgatgacatctttacggccaacgaaatggagtccgcgtttgaggtatatcgtaaatatatggcgtcaaaaaacgatgataaacttaagaaagaaatcactgagatttttacagaccttcgcaaaaaaattgcgaaagccttcgaaaataaatcgaaggagtattgcctttacaagggggatttctcgaaattgattaacgaaaaaaaaactggtaaggataaaggccccgggaaactgtggtattggcttaaagcgaaggcagacgctggtgtcaacgagttcggtgacgggcaaactttcgagcaggcagaagaagccttagctaagtttaataattttagcacctactttacaggtttcaatcaaaatcgcgacaatatttacactgatgcggaacagcagaccgctatctcatatcgtgttatcaatgagaacatgacacgttacttcgataattgcatccgctattcttcaatcgaaaacaagtatcctgaacttgtgaaacaactggagccccttagtggtaagttcgctccaggaaactataaagactatctgtctcaaacagcgattgatatctataatgaggctgtcggacacaaaagtgacgatattaacgcgaagggtatcaaccaattcattaacgagtatcgccagcgtaactcaattaaggggcgcgaattgccgattatgtcagtgctgtacaaacaaatccttagtgatatcaacaaggacttaatcatcgacaagttcgagaacgctggagagctgcttgacgcagttaaaactctgcatcgtgagttgacggacaaaaaaattttgcttaaaattaagcagacgttgaacgagttcttgacagaagataatagcgaagacatttatattaagtcaggcacagatttaaccgcggtgtcgaacgccatctggggtgaatggtccgtgattcccaaggcgttagaaatgtacgcggaaaacatcacggatatgaacgctaaagcacgtgaaaaatggttgaaacgtgaagcatatcatcttaagacagtacaagaagcgattgaggcatatttgaaagacaatgaggagtttgaaacacgtaacatctccgaatacttcacaaatttcaagagcggagagaatgaccttattcaggtagtacagtcggcttatgccaaaatggagtctatctttggtattgaggacttccacaaggatcgtcgcccagtgaccgaatcgggtgaaccgggagagggttttcgccaggtagagttagtccgcgagtatcttgatagtcttattaacgtagaacactttatcaaaccacttcatatgtttcgcagcggtaagccgattgagctggaagattgtaatagtaacttctacgatccacttaacgaagcttataaagagttggatgttgtgtttggcatctacaacaaagttcgcaactacgtgacacaaaaaccctattcgaaagataaatttaagattaacttccaaaactccacgcttttagacggttgggacgttaacaaggaatctgccaactcttccgtattgttgttgaaaaatgggaaatactatctgggggtgatgaaacaaggcgccagcaatattttaaactaccgtccagaacctagcgattccaagaataaaattaatgctaagaagcaacttagcgagattgctttggcgggtgccactgacgactattatgagaaaatgatctataagttgttgccggacccggccaaaatgctgccaaaggttttctttagtgcgaaaaatatcgagttttacaatcctagtcaggaaatcatctacattcgcgagaatgggttattcaaaaaagacgcaggtgataaggaatcactgaagaagtggattggtttcatgaaaacaagtttgctgaaacacccagaatggggcagttacttcaattttgaatttgagcctgccgaggactatcaggatatctcaatcttttacaaacaggtcgcagaacaaggctattccgtcacctttgacaagatcaagacgtcgtacattgaggagaaggtagcaagcggagaactttatttattcgaaatttataataaagatttttcgccgcattccaagggtcgtcccaatcttcatactatgtattggaaatcattattcgagaaggaaaatctgcaaaacttagtgacgaaactgaatggcgaggccgaggtattctttcgccaacatagcatcaagcgtaacgaaaaggttgtacatcgcgccaatcgtcctatccagaacaagaatccactgacagagaaaaaacagtcaattttcgaatatgatttggttaaagaccgccgttttacgaaggacaagtttttcttacattgccccatcactttgaacttcaaggaggctggccccgggcgctttaacgacaaagtgaataagtatattgcaggtaacccggacattcgtatcatcgggatcgaccgcggggagcgtcaccttttatattactcgcttattgaccaaagtggccgtatcgttgagcagggaacactgaaccagatcacgtctaccttaaatagcggagggcgcgaaatccctaagacgacagattaccgcggcttactggacacaaaggagaaggaacgtgacaaggcccgcaagtcctggtctatgatcgaaaacattaaggaacttaaatcgggatatttatcgcatatcgtgcacaagttggctaaattaatggtcaagaacaacgcagttgtagtattggaagacttgaacttcgggtttaagcgcggacgtttcaaagtcgaaaagcaagtgtaccagaaattcgaaaaagcattgatcgagaaactgaattatttggtttttaaagacgcccgccccgcagagccagggcactacttaaacgcttaccaactgacggctcctctggagtcattcaaaaaacttggtaagcaatcaggcttcatttattacgttcccgcatggaacacgtcgaagattgatccagtcactggcttcgtgaatcagttttacattgaaaaaaatagtatgcaatatttaaaaaatttcttcgggaaatttgactcgatccgttttaatcccgacaagaactacttcgagtttggtttcgactataaaaacttccacaataaggcagcgaaatctaagtggaccatctgtactcatggagataagcgcagttggtacaaccgcaagcaacgcaaacttgagatccataacgttactgagaacctggcgtcgcttctgtccggcaaaggcattaacttcgctgatggtgggtccatcaaagacaaaattcttagtgtagacgacgcaagtttttttaagtctttagcttttaacttcaaattgaccgcccaacttcgccatacctttgaagataatggagaggagatcgattgcatcatctcgcccgttgcagctgcagatgggacttttttctgttcggaaacggctaaaaaacttaatatggagttaccgcatgacgcagatgctaacggggcgtataatattgcacgtaagggactgatggtcttgcgtcaaatccgcgaatcgggcaagccaaaaccgatctcaaacgcggattggcttgatttcgcgcaacaaaatgaggattga

SEQ ID NO: 21 - DNA, 3888 bp, Artificial Sequence
  Description of Artificial Sequence: Synthetic polynucleotide
atgagcgctgtttttaagatcaaggagtcgacaatgaaagatttcacccatcagtacagtttatcgaaaacgctgcgtttcgaattgaaacctgtaggggagacagctgagcgcatcgaagattttaagaaccaaggcttaaaatcgattgttgaagaggatcgccagcgtgcagaagattacaaaaaaatgaagcgcatcttggatgactatcacaaagagtttattgaagaggttcttaatgacgatattttcaccgccaatgaaatggaatcggctttcgaggtgtatcgtaagtacatggcttccaaaaatgatgacaaactgaaaaaggaaattactgagatcttcactgatttgcgtaaaaaaatcgctaaggcgttcgagaataaatctaaagaatactgtctttacaaaggtgatttttcaaaattgatcaacgaaaaaaagacgggtaaagacaaagggccagggaagctttggtattggctgaaggcgaaggcagacgcaggcgttaacgagtttggtgacgggcagacattcgagcaagccgaggaggcattagccaagtttaataacttcagcacgtattttacgggttttaaccaaaaccgtgacaacatttacactgacgcagagcaacagactgcaatctcataccgcgttattaatgaaaacatgactcgttactttgacaattgtatccgctatagcagtatcgagaataagtacccggagctggttaaacagttggaacccttaagcgggaagttcgctccagggaactataaggattatctgtcccagactgcaatcgatatctataatgaggctgtagggcataagtcagacgatatcaatgcgaaggggatcaatcagtttatcaacgaataccgccaacgtaactcgatcaagggccgcgaattaccgattatgtctgtgttatacaaacaaattttatcagacattaacaaagacttaattatcgacaagttcgagaacgccggagagcttcttgatgctgtaaagactcttcaccgtgaattgaccgataagaagatcttattgaaaattaaacaaacacttaacgagttcttaaccgaggacaattcggaagacatttacatcaaaagtggtactgatctgactgctgtttctaacgcgatctggggagagtggtccgttatcccaaaagctttagaaatgtatgctgagaacattacggatatgaatgcaaaggctcgtgagaaatggttaaagcgcgaagcgtatcatttgaagactgtacaagaggcgatcgaagcgtatcttaaggataacgaggagtttgagacccgtaacatctcggagtactttactaattttaaatccggcgagaacgatttaattcaggtggttcaatcagcatacgcaaaaatggaatcgatttttggaattgaagactttcataaggatcgtcgccccgtgacagaatctggcgaaccgggtgaagggttccgtcaggtcgagttggtgcgcgaatacttggactcattaattaatgttgagcactttattaaaccgcttcatatgtttcgttcaggcaaacccattgaacttgaggactgtaattctaatttttatgacccgttaaacgaggcatacaaggaattagacgtagtgttcggtatttacaacaaagtacgcaactacgtcacccagaagccatactcgaaagacaaatttaaaatcaattttcagaactctactttgttagatggttgggacgtcaataaggaatcagccaactcatcagtactgttacttaaaaacggcaaatattacctgggtgtcatgaaacaaggggcgagtaatatcttgaattaccgtcccgagccttctgattctaagaataaaattaacgctaaaaagcagttgagcgagatcgccttagctggcgccacggacgattactacgagaaaatgatctataaactgttgcctgatccggcaaagatgctgccgaaagttttttttagcgccaagaacattgaattttacaaccctagtcaagagatcatctacatccgcgaaaatggtcttttcaagaaagacgcaggagataaagaatcgcttaagaagtggattggctttatgaaaacgagtcttttgaagcacccggagtggggttcttatttcaattttgagtttgagcctgcagaggactaccaggatatctccattttttataagcaagtggcagaacagggatattccgtgacgttcgacaagatcaagacaagctatatcgaagaaaaggttgccagtggagagctgtaccttttcgagatctataataaagatttctctcctcactccaaaggccgtccgaacttgcatacaatgtactggaaaagtctgttcgaaaaagagaatctgcagaacttggtgacaaaattgaatggagaagcagaagtttttttccgccaacacagtattaagcgtaacgaaaaagtcgtacaccgcgcgaaccgtccaatccaaaataagaatccgttgacagagaaaaaacagtcaatctttgaatacgatcttgtgaaggatcgccgctttacaaaagacaagttttttttacactgtcctatcacattaaattttaaagaagctggacccggccgtttcaacgataaggtcaacaagtacatcgccgggaaccccgatatccgtattatcggcattgaccgtggagagcgccacttactgtattattctttaattgatcagagcggacgtatcgtagagcaagggacgcttaaccaaattacctcaactcttaattctgggggtcgtgagatcccgaagactactgattaccgcggattgttggacacgaaggaaaaagaacgtgacaaagcacgtaagagctggtccatgatcgagaatattaaagaacttaaaagtgggtatctgtctcacatcgtccataagttggcgaagcttatggttaaaaataacgcggtcgtcgtattggaggatttgaattttggtttcaaacgcggacgttttaaggtagagaagcaggtgtatcagaaattcgaaaaagctttaattgaaaagcttaactatctggtatttaaggacgcacgtccggctgaaccaggccattatttaaacgcataccaattaacggccccgcttgagagttttaagaaattaggtaagcagtcaggctttatttattacgttccagcgtggaacaccagcaagattgaccccgtaaccgggttcgtaaatcaattctacattgagaagaactctatgcagtacttgaaaaacttctttggcaagttcgattccatccgtttcaatccagacaaaaactatttcgagttcggattcgactacaaaaatttccacaataaagctgcaaaatcgaagtggacgatttgcacacacggagacaagcgtagttggtataaccgcaagcagcgtaaattggagattcacaatgtcaccgaaaacttagcttcgttgttatccggcaaggggattaattttgctgacggcgggtctatcaaagacaagatcttatctgtggatgacgcatcctttttcaagtcattagcgttcaatttcaagttaacagcgcaactgcgccatacattcgaagacaacggagaggaaatcgactgcatcatctcccccgttgcggcagcagacggaactttcttttgctctgaaacagcgaaaaaattaaatatggagctgccacacgatgctgatgccaatggagcatataacatcgcccgcaaaggcttaatggttttacgccaaatccgcgaatctggcaaaccaaaacccatctcgaatgctgattggttggactttgctcagcaaaacgaagactga

SEQ ID NO: 22 - DNA, 3888 bp, Artificial Sequence
  Description of Artificial Sequence: Synthetic polynucleotide
atgagtgctgtctttaaaattaaggagtccacgatgaaggactttactcatcagtattcactttccaaaactcttcgcttcgagttaaaacccgtcggagaaacagcagaacgtatcgaagatttcaaaaatcaaggccttaagtcgattgtggaagaggaccgtcagcgcgccgaggactataaaaaaatgaaacgtattttggacgattatcacaaggaattcattgaggaggtattgaatgatgatatctttacagctaacgaaatggaatctgctttcgaggtgtatcgtaagtacatggcctccaagaatgatgataaattgaaaaaggaaatcaccgaaattttcacggatctgcgcaaaaaaattgcgaaggcatttgagaataaaagcaaagagtactgcttatacaaaggagacttttcaaaattgatcaacgagaaaaaaacggggaaggataagggtccgggaaagctgtggtactggcttaaagcaaaagcagatgctggggtgaacgagtttggagacggccaaacctttgagcaagcggaggaagcccttgctaaatttaataatttttccacttatttcacaggcttcaatcaaaaccgtgataatatttacaccgatgctgagcaacaaacagcgatctcgtaccgcgttatcaatgagaatatgacccgttactttgataactgtattcgttattcatcaattgagaacaagtaccccgaactggtgaaacagttggagcctctgtccggcaagttcgctccagggaattataaagactatctttcgcagactgcaatcgatatctataatgaggctgtgggccacaaatctgacgatatcaacgcgaagggcattaatcaattcatcaacgagtaccgtcaacgtaattccatcaaggggcgcgagttgccgattatgagtgtactttacaagcaaatcctgagcgacatcaacaaggacctgatcattgataagtttgagaacgccggcgaactgctggatgcagtcaaaactttgcatcgcgagcttaccgataagaagatcttgcttaaaatcaaacaaactctgaacgaatttttaaccgaagataattcagaggacatctatatcaaatccggtactgacttaacagcggtgagcaacgcgatctggggcgagtggtcagtcatcccgaaagcattagaaatgtatgccgagaatatcaccgacatgaatgccaaagcccgtgaaaaatggctgaaacgtgaggcataccatcttaagactgtacaagaagcgattgaagcatacctgaaggataatgaagaattcgaaactcgtaacatctcagagtatttcacaaattttaaaagcggagagaatgacttaattcaagtagtccaaagcgcttatgcgaagatggagagcatttttggtattgaggactttcataaagaccgtcgccccgtaacggagagtggggaaccaggagaagggttccgtcaagttgagttagttcgtgagtatttagactctttgattaacgttgagcatttcattaaaccactgcatatgtttcgctccggaaagcctattgagttggaagactgcaactccaatttttatgaccctcttaatgaagcctacaaagaattagacgtagtctttggaatttataacaaggtccgcaactatgtcacgcaaaaaccttattcaaaagacaaatttaagatcaacttccagaactcgacgcttcttgacggatgggacgtgaacaaagagagcgccaattcatcggttttactgctgaaaaacggaaaatactacttgggagtaatgaaacaaggagccagtaacattctgaattaccgccctgagccttcagactctaaaaacaagatcaacgctaaaaaacagctgagtgagatcgcattagccggtgcaacagatgactattacgaaaaaatgatttacaagttattacccgatccggccaaaatgcttccgaaagtctttttttcggccaaaaatattgagttttataatccttcacaagagattatctacatccgtgaaaatggccttttcaagaaggatgcgggcgataaggagtctttgaaaaagtggattggctttatgaagacaagtttattgaaacacccagagtggggtagttatttcaactttgagtttgagcccgcagaggattatcaagacatttctatcttctataaacaggtggctgaacagggttattctgtcacgttcgacaaaattaaaacctcctatatcgaggagaaagttgcatccggcgagctttatcttttcgagatctacaacaaagactttagccctcattctaaaggccgcccgaacttacataccatgtattggaagtctcttttcgaaaaagaaaatctgcaaaatttggtgaccaaactgaatggtgaggccgaagttttctttcgccagcacagcatcaaacgcaacgaaaaagtggtgcatcgcgccaatcgtcccattcagaataagaacccccttacggagaagaagcagtctatttttgagtacgatttagtgaaagaccgtcgttttactaaggataagttttttctgcattgtccgatcactttaaatttcaaagaagctggtcctggccgtttcaacgacaaggtgaacaagtacatcgccggcaatccagatatccgtattattgggatcgatcgcggtgagcgccatttactttactactcgctgatcgaccaaagcgggcgtattgtcgagcaaggaaccttgaatcagatcacgagtacactgaactcaggagggcgtgagattcccaaaacaaccgactatcgtggattgttagacacaaaagaaaaagaacgtgataaagcccgcaagtcttggagcatgattgagaacattaaagaacttaaatcgggatacttatcccacatcgttcacaaacttgcaaaattgatggtgaagaacaatgcagtagtagttttggaggacctgaactttggttttaaacgtgggcgcttcaaggtggaaaaacaggtgtatcagaagtttgagaaggcattaattgagaagttaaattatctggtgtttaaagacgctcgccctgccgagcccggtcactatttgaatgcttatcagttgacggcgcccttggaaagttttaagaagttaggtaaacagtctggattcatctattacgtcccggcgtggaacactagcaaaattgacccagtcactggtttcgtaaatcagttctacattgaaaaaaactctatgcagtatttgaagaattttttcggaaaattcgattcgatccgttttaatccggataaaaattactttgagttcggatttgactacaaaaacttccacaacaaggcggcgaaaagtaagtggaccatctgcacccacggggataagcgcagttggtataaccgcaagcagcgtaagctggagatccacaacgtgacagagaacctggcttcgttattgtcgggcaagggaattaactttgctgacgggggctctatcaaggacaaaatccttagtgttgatgatgcaagcttcttcaaatccttggcgtttaactttaagcttaccgcccaactgcgccataccttcgaggacaatggtgaagaaattgattgtatcatcagcccggttgcagcggcggacggtacgttcttctgttcagagacagccaagaagttgaacatggaattgccccatgacgcagatgctaatggggcctacaacatcgcacgtaaggggctgatggtgcttcgtcagatccgcgaaagcggaaaacctaaacctatctctaatgccgattggttggatttcgcacaacagaacgaagattga

SEQ ID NO: 23 - DNA, 3738 bp, Ruminococcus bromii
atgcaagagcgtaaaaaaatatcgcatcttacacacagaaattcagttcaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccgggttagataaattaaaagattatgctgaaatttactatcactgtaatacggatgcagaacgaaaaagacttgacgaatgtgcatcggaattaaggaaagaaatcgtcaaaaattttaagaatcgagatgagtataacaaactattcaataaaaagatgattgagatagttcttccccagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagcatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattctgaaaatgatgaaatcagagaaaagtctatcgtaaattactacaagacttctttaatgcaacttaccgacaatttgtcagacaaatacaacgaagcagcacctctgctcaacaaaagttacgctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactacgttacacaaaaaccgttttcaaccgataaaatcaagcttaactttggcaattcacagctattaaacggctgggatcgaaacaaagaaaaagactgcggtgccgtttggctttgtagggatgaaaagtattatcttgcaatcatagataaaagtaataatagtattttggaaaatattgattttcaagactgcgatgaaaacgattgttacgaaaagataatttacaagcttctccccggtccaaataaaatgcttccaaaagttttcttttcagaaaagtgcaagaaacttttgtcaccgtcagacgaaatacttaaaattcgtaaaaacggcactttcaaaaaaggtgataagttcagccttgatgattgccataagttaattgatttctacaaagaatcattcaaaaagtacccaaattggttaatttataactttaaatttaaaaacacaaacgaatataacgatatccgcgaattttataatgatgttgcttcacagggatataatatttcaaaaatgaaaatcccgacatcatttattgacaaacttgtagatgaaggaaaaatctatcttttccaactctacaacaaagacttttcaccgcatagcaaaggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaaaaacaagcacttttccttatgacttaattaaagataaacgctacactaagtggcagttttcacttcacttccctattaccatgaattttaaagctccggatagggcaatgatcaatgatgatgtcagaaatctgctgaaatcctgcaacaacaatttcatcataggaattgacagaggcgaaagaaacttgctttatgtcagcgtaattgacagcaacggtgctataatataccagcactcactcaatattatcggaaacaagtttaaaggaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaactgaattactatgttgacaaaaagcttgatccagacgaaggaggcggtttacttcatgcctaccagcttacgaacaagcttgagagctttgataaacttggcatgcaaagcggttttattttctatgttcgtcctgattttacaagcaaaattgatcccgttaccggctttgtaaatttgttgtatcctcgatatgaaaacattgacaaagccaaagatatgatttcaagatttgacgatataggatacaatgccggcgaggacttttttgaatttgacattgattacgataagtttccaaagactgcgtctgactatcgcaagaggtggacaatctgtactaacggcgaaaggattgaagctttcagaaatcccgcaaagaataacgaatggagttatcgtacaataattcttgcagaaaaattcaaagaattatttgataacaattctataaattatcgtgattctgacgatttgaaagctgaaattctttcacagacaaagggcaaattttttgaggatttcttcaaattattaagacttaccctacagatgcgaaacagtaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaatccgataatgtttcaactgtcggaccggtaatccacaatgacaaatggctgaaatttgttcaggagaatgatatggcgaataattaa

SEQ ID NO: 24 - DNA, 3738 bp, Artificial Sequence
  Description of Artificial Sequence: Synthetic polynucleotide
atgcaagaacgtaagaaaattagccatcttacccaccgtaatagtgttcaaaagacaatccgcatgcagttgaaccccgttgggaagacaatggactacttccaggctaagcaaatcttggagaacgatgaaaaattaaaggagaattaccaaaagattaaggagattgccgaccgtttctaccgtaacctgaacgaagacgtcttgtctaagaccggtttagacaaacttaaagattacgccgagatctactatcattgtaacaccgatgccgagcgcaagcgtttagacgagtgcgccagtgagctgcgcaaagaaattgtaaaaaattttaaaaaccgtgacgaatacaataagctgtttaataagaagatgatcgagatcgtcttacctcaacaccttaaaaacgaagacgaaaaggaggtagtagcgtccttcaagaactttacgacttattttacagggttctttactaatcgtaagaatatgtactcagatggagaagagtcaacagctattgcttaccgctgtattaatgaaaacttaccaaaacacttagacaacgtgaaagctttcgaaaaggccatctctaaacttagtaaaaacgcaatcgacgaccttgatgccacgtactccgggttatgcggtacaaacctgtacgacgtctttacggttgactactttaacttcttgcttccacagagcggcatcaccgaatataataaaatcatcggtggctatactactagcgatggaacaaaggtaaagggaattaacgagtacatcaatttgtacaatcagcaagtgtcgaagcgtgacaaaattcctaatcttaagattctttataagcagatcctttccgagagcgaaaaagtttctttcattccgcctaagttcgaagacgataacgaattactgagcgctgtcagtgagttctatgctaacgacgagacttttgacggcatgccactgaagaaagcgattgacgaaaccaagctgttattcggtaatttggataactctagccttaatggcatttatatccagaacgatcgttctgtaacgaatttgtcaaactcgatgtttgggtcgtggagcgtaatcgaagacttatggaataagaactacgacagcgtaaatagcaacagtcgtattaaagatattcagaagcgtgaagataagcgcaagaaagcatataaagccgaaaagaagctttctttatccttcttgcaggtcttgatctcgaattcagaaaacgatgaaatccgtgagaagtcgattgtaaattattacaaaaccagtctgatgcaacttactgataacctgtcagataagtataacgaagcagcccctctgttaaataaatcttatgctaatgagaagggattaaaaaatgacgacaaatctatttcgttgattaagaacttcttagatgctatcaaggagattgaaaagttcatcaaacctttaagtgagacaaatatcacgggagagaagaatgacctgttctatagccaattcactcctttattagacaacatttcccgtattgatatcctgtatgataaggttcgtaattacgttacccaaaaaccattctccaccgacaagatcaaactgaactttgggaacagccaattattgaacggatgggatcgcaacaaggaaaaggattgtggtgctgtgtggttgtgccgtgatgaaaaatattatttagcgattattgacaaatcaaacaattcgattttagaaaatatcgattttcaggactgtgacgaaaatgattgttatgaaaaaattatctataaattgttgcccggccccaacaagatgctgcccaaggtgttcttctcggaaaaatgcaagaaattattatcaccctcagatgaaattttaaaaattcgcaagaatgggacattcaagaaaggggataagttcagtttggacgattgccataagctgatcgacttttataaagaaagcttcaagaaatatccaaactggttaatttataattttaagtttaaaaacacaaacgagtacaacgacatccgtgaattttataacgacgtcgcaagtcaaggttataatatcagtaaaatgaagattccaacgagtttcattgacaagttggttgacgagggtaagatctacttgtttcagctttacaataaggatttttctcctcattcaaaaggtacccccaaccttcatactctgtattttaaaatgctttttgatgagcgcaacttagaggacgttgtttacaagttgaacggggaagcggagatgttttatcgtccagcatcaattaagtatgataaacccacgcatcccaaaaacacgccaatcaagaacaagaatacactgaacgataaaaagacatcgaccttcccctacgatttaattaaggataagcgttacacgaaatggcagttctccttgcactttccgattaccatgaacttcaaggcccccgatcgtgccatgatcaatgacgatgtacgtaaccttttaaagtcttgtaataacaatttcatcattggcattgaccgtggagagcgcaacttgttgtatgtcagtgtgattgacagtaatggggcaattatctaccagcactcattaaatattattggcaataaattcaaaggtaagacttatgagaccaactatcgcgagaagctggcaacacgcgagaaggagcgtacggaacagcgccgcaactggaaagctattgagtctattaaggagcttaaggagggttacatcagtcaggccgtacatgtgatctgtcagttggtggtcaaatacgatgcgattatcgtgatggagaagctgacagacggctttaagcgtggtcgtacgaagtttgagaaacaagtctaccaaaagtttgaaaagatgctgatcgataagcttaactattatgtcgataagaaattagatcccgacgagggggggggattgcttcatgcataccagcttactaacaaattagaaagtttcgacaaattaggtatgcagagtgggtttattttctatgtccgtcccgattttacgagtaagatcgatcctgttactgggtttgtcaacctgttgtaccctcgttatgagaacattgacaaggcgaaggatatgatctctcgctttgacgacattgggtacaatgctggtgaggacttctttgaattcgacattgattatgacaagtttcctaagactgcctccgactaccgtaaacgttggacgatttgtactaatggggaacgtatcgaggctttccgtaatccagcgaaaaacaacgagtggtcttaccgcaccatcattttggcggagaaattcaaagagcttttcgataacaatagtatcaactaccgcgattcggacgacttaaaggctgagatcctttctcaaacgaaaggtaaatttttcgaagatttttttaaactgttgcgtcttaccttgcaaatgcgcaatagtaacccggagactggtgaggatcgtatcttgtcccctgtcaaggacaaaaacggtaatttctacgatagctccaaatacgacgagaaatcaaagttgccatgtgatgccgatgcaaacggggcgtacaacattgcgcgcaaaggcttatggattgtcgaacagttcaagaagtctgataatgtgtcgactgtcggacctgtaatccacaacgacaagtggcttaagtttgtgcaagagaatgatatggcaaataactaa

SEQ ID NO: 25 - DNA, 3738 bp, Artificial Sequence
  Description of Artificial Sequence: Synthetic polynucleotide
atgcaagagcgtaagaaaatttcacaccttacacatcgtaatagtgtccagaaaacgatccgtatgcaacttaatccagtcgggaaaactatggattactttcaggcaaagcaaattttagaaaatgacgagaaattaaaagaaaactaccaaaagatcaaagagatcgctgaccgtttttatcgcaacttaaacgaggatgtccttagcaaaacagggctggacaagttaaaggattacgcggagatttattaccactgcaacaccgacgctgagcgtaaacgtcttgacgagtgtgcatcggagttacgcaaggaaatcgtaaagaactttaagaatcgcgacgagtacaataagttattcaataaaaaaatgattgaaatcgtgcttccccaacatttgaaaaacgaagatgagaaggaggtggtcgcgtcgttcaaaaactttaccacctatttcaccgggttttttaccaaccgtaagaacatgtattcggacggtgaggagtctactgcaattgcgtaccgttgcattaatgaaaaccttcctaaacacttagacaacgtcaaagcttttgaaaaggctatctcgaaacttagtaaaaacgccatcgatgatttagacgccacgtatagcggcctttgcgggacaaatttatacgacgtgtttacagtagactactttaacttcttgcttcctcagtccggcattactgagtataacaagatcattggcggatacaccacgtctgacggtaccaaagtcaaagggatcaatgagtacattaatttatacaaccaacaagtatcaaagcgcgataaaatcccgaacctgaagattctttataagcaaattctgtctgaaagtgagaaagtatcctttatcccaccgaaatttgaggacgacaacgaactgttgtcggctgtttctgagttctacgcaaatgatgagacctttgacggtatgcctttaaaaaaggccatcgatgaaacaaaattgctgtttgggaacttggataattcctctcttaatgggatttacattcagaacgaccgcagcgtaacgaatttgtccaattcaatgtttggatcgtggtccgtgatcgaagacctgtggaataagaattacgattcagtcaattccaacagtcgcattaaggacatccaaaagcgcgaagacaagcgcaagaaagcatataaggccgaaaagaaactgtctttatcatttcttcaggttttaattagtaactctgagaacgatgagattcgcgagaagtccatcgtgaactattataagacgagtttaatgcagttaacagataacttatctgacaagtacaatgaagcggctcccttgttgaataagtcttacgccaatgaaaaaggtcttaagaatgatgacaagtctatcagcttaatcaagaattttttggacgcgattaaggaaatcgaaaaattcattaaaccattgtccgagactaacattaccggagagaaaaacgacctgttctactcccaattcacaccgttgctggataacatctcacgtatcgacatcctttatgataaggtgcgtaactacgttactcaaaagcccttttccaccgacaagattaagttgaattttggtaacagtcaattgctgaacggctgggatcgcaacaaggaaaaagactgtggtgctgtctggttatgtcgcgacgaaaaatactatctggctattattgataaatctaataactctatcttagaaaacatcgactttcaggactgcgacgagaacgactgctacgaaaagattatctataagttacttcctggccccaacaagatgttaccgaaggtcttttttagcgaaaagtgcaagaaattgctgagtccatctgatgagattcttaaaattcgcaagaatggcactttcaagaagggggacaagttttcccttgatgactgccacaaacttattgacttctataaagaaagttttaagaaatatcctaactggttaatttacaacttcaaattcaaaaatactaacgaatacaatgatattcgtgagttctataatgacgtcgcctcccagggttataacatcagtaaaatgaagatccctacctcctttatcgataaacttgttgatgaaggaaagatctatttatttcaactgtataataaagatttttcgccccatagcaaaggcacacctaatttacatacgctttacttcaaaatgctttttgatgagcgtaatttagaggatgtggtctacaaacttaatggcgaggctgagatgttttaccgccctgcatctattaagtatgataagccaacacaccccaaaaatacgccaattaaaaacaagaatacgcttaacgataaaaaaacgagtaccttcccgtatgatcttattaaggataagcgttacacgaagtggcagttttctctgcattttccaatcacaatgaacttcaaggccccggaccgtgcgatgatcaacgacgacgtacgtaacttgctgaaatcttgtaacaacaacttcattatcggcattgatcgtggcgaacgcaatctgttatacgtgtccgtcatcgattcaaatggagcgatcatttaccaacatagcctgaacatcattgggaacaagttcaaggggaagacctatgagactaactaccgtgaaaaattggcgacccgcgaaaaagaacgcacagagcagcgtcgcaactggaaagctatcgagagcattaaggagcttaaagaaggttatatctcacaggcggttcatgtcatctgccaattagttgtgaagtatgatgcaattatcgtgatggagaaactgaccgatggattcaaacgcgggcgtaccaaattcgaaaaacaggtttatcagaaatttgaaaaaatgctgatcgacaagctgaattactatgtagacaaaaaactggatccagatgagggagggggtctgcttcatgcataccaacttactaataagttggaatctttcgataagttgggaatgcagtcggggtttatcttttatgtacgccctgatttcacgtcgaagattgatccagtgaccggtttcgtaaaccttctgtaccctcgttatgagaacattgataaggccaaagatatgatttcacgtttcgatgatattggttataatgccggggaagattttttcgaatttgatatcgactacgacaaattcccaaaaacagcttcagactatcgtaaacgttggactatttgtaccaatggagaacgtattgaagctttccgtaatccagctaagaataatgaatggagttatcgtacgattatcttggcggaaaaattcaaagaattattcgacaacaattccattaactatcgtgacagcgatgatttgaaggccgaaatcttgtcacaaaccaaggggaaatttttcgaagacttttttaaactgttacgtctgacgcttcaaatgcgcaattcaaacccggaaacgggggaagatcgtattcttagccctgtaaaagataagaatggaaacttttatgacagttccaagtacgacgagaaatctaaattaccttgtgacgcagatgcaaatggggcttataacatcgcgcgcaagggcctgtggattgtcgaacagtttaagaagtcggacaacgtatcgactgttggaccagtaattcacaatgacaaatggctgaaattcgtccaggagaatgatatggcaaacaattaa

SEQ ID NO: 26 - DNA, 3738 bp, Artificial Sequence
  Description of Artificial Sequence: Synthetic polynucleotide
atgcaggaacgcaagaaaattagccaccttacgcatcgtaacagtgttcagaagacaatccgcatgcagctgaatccagttggaaagacgatggattacttccaagccaaacagattttagagaacgatgagaaattaaaagaaaactaccagaaaattaaagaaattgctgatcgcttttaccgtaacctgaacgaagatgtgttatcgaagaccggcttggacaagctgaaggactatgccgagatttattaccactgcaatactgacgcagaacgtaaacgtctggatgaatgcgcctccgaacttcgtaaggaaatcgtcaaaaacttcaagaatcgcgacgagtataataaattgtttaataaaaagatgatcgaaatcgtgttgccacaacacttaaaaaacgaagacgagaaggaggttgtcgcgtctttcaaaaacttcaccacatattttacgggttttttcaccaaccgtaagaacatgtactctgatggcgaagaatcaactgctattgcctaccgttgtattaacgagaatctgccgaagcacttggacaacgtaaaggccttcgaaaaggcaatctctaaactgtctaagaacgcgattgacgacttggacgcaacatactcgggcttatgcgggacaaatttgtatgatgtatttactgtggactactttaattttcttttgccgcagtcaggtattaccgaatacaataagatcattggcggctacaccacatctgacggcacgaaggttaaggggattaacgagtatattaatttatacaatcagcaagtatctaagcgtgacaagattccaaacctgaagatcctgtacaagcagattctttcggaatccgagaaggtctcctttatcccacccaaatttgaagacgacaacgaacttctgtcagcagttagtgagttctacgcgaatgacgagacatttgatggaatgccgctgaaaaaagctattgatgagacaaagcttttattcggtaacttggataactcaagtttgaacggcatctacatccagaatgaccgctcagtgacgaacttgtccaatagtatgtttggtagttggtccgtaatcgaagatttatggaataagaattatgattctgtgaacagtaactcccgtattaaggatatccaaaagcgtgaagacaagcgtaaaaaagcgtacaaagcggaaaaaaaactgtccttatcatttttacaagtacttatcagcaactcggagaacgacgagatccgtgaaaagagcattgtaaactattacaagacgagcctgatgcaacttacggataaccttagtgataagtataacgaggcagcaccgttacttaataaatcgtatgctaacgaaaagggactgaagaatgacgataagtctatctcgttaattaaaaacttcttagatgccatcaaggaaattgagaaatttattaagccacttagcgagacgaacatcacaggggagaagaacgacttgttttattcacaatttacgcctcttcttgataacatcagtcgcattgacattttatacgacaaagtacgtaactacgtgacacagaagccattctcaaccgacaaaattaaacttaacttcggtaattcccaattgcttaatggttgggatcgcaacaaagagaaagattgtggcgctgtgtggctttgtcgcgacgagaagtactatcttgccatcattgacaagagtaataatagtattttagaaaatatcgattttcaggactgtgacgagaatgattgctatgagaagatcatttacaaactgctgccagggcccaacaaaatgttgcctaaggtcttcttcagcgaaaaatgcaagaagctgctttcacctagtgacgaaatcctgaagattcgtaaaaatggcacgtttaagaaaggcgacaagttttcgcttgatgattgccataagttgatcgacttctataaagagtcatttaaaaagtaccccaactggctgatctacaatttcaagttcaagaacaccaatgagtataacgatattcgtgagttctataatgatgttgcatctcagggatataacattagcaagatgaaaatcccaactagttttatcgacaagctggtcgacgaaggaaaaatttatcttttccagctttataacaaagatttctcacctcatagtaaaggcacacccaatttgcacactttatacttcaaaatgcttttcgacgaacgtaatttagaggatgtggtgtataagttaaacggagaggctgaaatgttttatcgcccagcatctattaagtacgacaaacctactcaccctaaaaacactccaatcaagaataagaacacattgaacgataaaaagactagtacttttccatacgatctgatcaaggataagcgctacactaagtggcagtttagcttgcattttccaattacgatgaacttcaaagcacccgatcgtgcgatgatcaacgatgacgtgcgtaatttgttaaagtcatgtaacaacaactttattatcggtattgatcgcggtgaacgcaacttattgtatgtttcagtcatcgactccaacggggcgattatctatcaacattcgctgaacatcatcgggaacaagttcaaaggaaaaacatacgagactaattaccgcgaaaaattagcaacccgcgaaaaggaacgcacagagcagcgtcgtaactggaaggcgattgagtccatcaaggaactgaaggaaggatatatcagccaggctgtgcatgtaatttgccaattggttgtgaagtacgacgcgattatcgttatggagaagctgactgatggattcaaacgcgggcgcacaaaatttgagaagcaggtctaccagaagttcgagaagatgttgatcgataagcttaactattatgtggacaaaaaactggacccagatgaaggcgggggattacttcatgcttatcaacttacgaacaaactggaatcgtttgacaagttaggaatgcaatccggatttattttttatgttcgtccggatttcacttctaaaattgacccagttacaggctttgtaaaccttctttatccccgttacgagaatatcgataaagcaaaggacatgattagtcgcttcgatgacatcggatataacgcgggggaggacttcttcgaatttgatattgattacgacaaatttccgaaaacagccagtgactaccgtaagcgctggacaatttgtacgaatggtgaacgtatcgaggcgtttcgtaaccccgcaaaaaacaacgaatggagctaccgcactatcattttggcagagaaatttaaggagcttttcgataacaacagcatcaactaccgcgatagcgatgatcttaaggccgaaattttgtcacaaactaaggggaaattttttgaagatttcttcaaactgttacgcttaaccctgcagatgcgtaactctaatcctgagacaggggaggatcgtatcctgagcccggtgaaggataaaaatggtaatttttatgatagttccaagtacgacgaaaaaagcaagttgccttgtgacgccgacgccaatggtgcttataacattgcgcgcaagggactgtggatcgtggagcagttcaagaagagtgataatgtgagcacggtcggcccagtcattcacaatgacaaatggttaaaattcgtgcaggagaatgacatggcgaacaattaa

SEQ ID NO: 27 - DNA, 3846 bp, Prevotella sp.
gtgaacattttaaaagagaattatatgaaagaaattaaagaactaacaggcttgtattctttaactaagactattggggtagaattaaagccagtgggtaagacgcaagagctcattgaagctaaaaagcttattgagcaggatgatcagcgtgccgaagattacaaaatagtaaaggatattattgatcgttatcataaggattttatcgataagtgtcttaactgtgttaaaatcaaaaaagatgatttggagaaatatgtgtcattggcagaaaactctaatagagatgctgaggattttgacaaaatcaagaccaaaatgcgtaatcagataactgaagctttcagaaagaattctttatttactaatttattcaagaaaaatcttattaaggagtatcttcctgcttttgtaagtgaggaagagaagagtgtggtgaacaaatttagcaaatttaccacttactttgatgcgtttaatgacaatcgtaaaaatttatattcaggcgatgccaaatccggtacgatagcttatcgacttattcatgagaatttgccgatgtttcttgataatatagcatcctttaatgcaatttctgggataggagtaaatgagtacttttctagtatagagacagaatttactgatactcttgaaggaaagcgtctgactgagttttttcagattgacttttttaataatacattgactcagaaaaagataggcaactataactatattgtaggggcagtcaataaagctgtaaatctttataagcaacagcacaaaacagttcgtgttccattgctcaaaccattatataaaatgatcttgagtgatagagttactccgtcatggttacctgaacgttttgaaagtgatgaagagatgctgactgccatcaaagctgcttacgaatctttgagagaagttttagtaggtgataatgatgaaagtcttcgcaacttattgctcaatatagagcattatgatcttgaacatatttacattgcaaatgattccggattgacttccatttcacagaaaatatttggatgttatgatacttatactttggcaatcaaagaccaactacaaagggattatcctgcaacaaagaagcaaagagaagctcctgatttgtatgatgaacgtatagataaattgtataaaaaggtgggtagtttttctattgcttatcttaatcggttagtcgatgcgaaagggcattttactattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 28 - DNA, 3846 bp, Artificial Sequence
  Description of Artificial Sequence: Synthetic polynucleotide
gtgaacatccttaaggagaactatatgaaagaaatcaaggagttgaccggtctttactcattaactaaaacaattggcgtcgaattaaagcccgtaggaaagacacaagagcttattgaggcgaagaagcttatcgagcaagatgaccaacgcgcggaggattacaaaatcgtaaaggacattatcgaccgctaccacaaagatttcatcgataaatgcctgaactgtgtaaaaattaaaaaagatgaccttgagaagtatgttagccttgctgagaactctaatcgcgacgctgaagatttcgacaaaatcaaaacaaagatgcgtaatcagatcactgaggcgttccgcaagaactctttattcaccaacttgtttaaaaagaatcttatcaaggagtatttgcccgcgttcgtcagtgaagaggaaaaaagtgtggtgaataaattcagcaaatttactacttacttcgatgcgttcaatgataatcgcaagaacctgtactccggtgacgccaaatccggaactattgcataccgtttaatccatgagaatttgccaatgtttcttgataatatcgctagctttaatgccatttcgggcatcggagtgaacgagtacttctccagcattgagacagagtttactgacacgctggaagggaagcgcctgaccgagttctttcaaatcgacttttttaacaacactctgacccagaaaaagattggcaactataactacattgtcggtgccgtcaacaaagccgtgaacttgtataagcagcaacacaaaacggttcgtgtcccgttgttgaagcccctgtataagatgattttgagtgaccgcgtaacgcctagctggctgcccgaacgtttcgaatctgacgaagaaatgttgaccgctattaaagctgcttacgagagccttcgtgaagtactggttggagacaatgatgaatcattgcgtaatcttctgcttaacattgaacattatgatttggaacacatttatatcgcaaatgatagtggcctgaccagtatcagtcagaagatttttggatgctacgatacatatactcttgccatcaaggaccagcttcagcgtgactatccagctactaaaaagcaacgcgaggcacctgatctttacgatgaacgcatcgataagttatacaaaaaagtaggttctttctcaatcgcctatctgaatcgtttagtggatgcgaaaggacactttactattaatgaatactacaagcaattaggggcatattgtcgtgaggagggcaaagaaaaagacgatttttttaaacgcattgacggggcctactgcgccatttcacatctgttctttggtgagcacggggaaattgcccaatctgacagtgatgtggaacttattcagaaattattagaagcctacaaggggcttcagcgttttattaaaccattacttgggcatggggatgaggctgacaaagataacgaatttgacgctaagcttcgcaaagtatgggacgagcttgacatcattacccctttatacgataaggtacgcaattggttgtcccgcaagatctataacccagagaagattaaattatgtttcgaaaataatggcaaactgctttcaggctgggttgacagtcgcacgaagtcagataacggtacgcaatatgggggatacatttttcgcaaaaagaacgagatcggggaatatgatttttatttgggtatttccgccgatactaagctgtttcgtcgcgatgcggcaatcagttacgatgacgggatgtatgagcgtctggactactatcagttgaaatccaagactcttttaggcaattcgtacgtaggcgattatggacttgactcgatgaacttattgtctgcatttaaaaacgcggcggttaagtttcaattcgagaaagaggtcgtcccgaaagataaagagaacgttccaaaatatttaaaacgtcttaagttagattatgcgggattctatcagattcttatgaacgatgacaaggtcgtggatgcatataaaattatgaaacagcacatccttgctactttaacgtcatcgattcgcgtgcctgctgctatcgaacttgccacccaaaaagagttgggaattgatgagcttatcgatgagattatgaatctgccttcaaagagttttggctacttcccaatcgtcaccgcagcgatcgaagaagctaataaacgtgaaaacaaaccgttattcttgtttaaaatgtccaacaaggacctttcctacgcagcaacggcctccaaaggacttcgcaagggacgtggaaccgagaacttacatagcatgtatcttaaagccttgttgggaatgacccaatcagtgtttgatattggtagcggtatggtgttctttcgccaccaaaccaaagggctggctgaaactactgcccgccacaaagcgaatgaatttgtagctaataaaaataagttaaatgataaaaaaaagtccatctttggatatgaaattgtgaagaataaacgcttcacggtagataaatatctttttaagttgtctatgaaccttaactacagccaaccaaacaacaataagatcgatgtgaattctaaagttcgtgaaatcatttcgaacggaggcattaaaaacatcattggtatcgaccgcggagaacgtaatcttctgtaccttagcttgattgacttaaaaggcaatattgtgatgcaaaagtcacttaatatcttgaaagacgaccacaacgcaaaggagaccgattacaaaggactgcttactgaacgtgaaggtgagaacaaagaggcacgccgcaattggaaaaaaattgctaacatcaaggatttaaaacgtgggtacctgtctcaggtagttcacattattagcaaaatgatggtcgaatacaatgcgattgttgtgttagaggatttaaaccctggcttcattcgtggtcgtcaaaaaatcgaacgcaatgtctacgaacaatttgaacgtatgttgatcgataagctgaatttttacgtggataagcacaaaggggccaacgaaaccgggggacttttacatgcgttacagttgacttctgaattcaaaaattttaagaaaagtgagcaccagaacgggtgcttgttctatattcccgcctggaatacaagcaaaatcgatcctgctacggggtttgtaaatttgttcaataccaaatatacaaatgctgttgaggcgcaagaattcttttccaaattcgatgagatccgttacaatgaagagaaagactggttcgagttcgaatttgattatgataagttcacgcaaaaggcccacgggactcgcacaaagtggactttgtgtacgtacggaatgcgccttcgttccttcaagaacagtgcaaagcaatacaactgggatagcgaggtagtagcattaaccgaggaatttaaacgtattttaggcgaggcaggtatcgatatccatgagaatttaaaggacgcgatctgtaacttggagggtaagtctcagaagtatctggaaccgttaatgcaattcatgaaattattactgcagctgcgcaattccaaagccggaactgacgaggattacattttaagcccggtagccgatgagaacggaatcttctacgatagtcgttcttgtggagatcaacttcctgaaaatgcagatgcgaacggagcatataatatcgcccgcaaaggcttaatgctgattgagcaaattaagaacgcggaggaccttaataacgtaaaatttgatatctcgaacaaggcgtggttgaacttcgctcagcaaaaaccttacaaaaatggctga

SEQ ID NO: 29 - DNA, 3846 bp, Artificial Sequence
  Description of Artificial Sequence: Synthetic polynucleotide
gtgaacatcttaaaagaaaactacatgaaggagatcaaagagctgaccggtttatattcgttaactaagacgatcggagttgaacttaaacctgtgggaaaaactcaggagcttattgaggcaaaaaagttgattgagcaagatgatcagcgtgctgaagactacaagattgttaaggatatcattgaccgctatcataaggatttcatcgacaaatgccttaattgtgtcaaaatcaagaaggacgatttggagaaatacgtatcacttgcggaaaacagtaatcgtgacgcagaagatttcgataagattaagacgaagatgcgcaatcagatcacggaggcatttcgcaaaaattccttgtttaccaatttgtttaaaaagaacctgattaaagaataccttcctgccttcgtatcagaggaagagaagtctgttgtaaacaagttcagtaaattcaccacgtactttgacgcttttaacgataatcgcaaaaacctttactccggtgacgccaaatcgggcactatcgcctatcgcttaatccacgaaaatctgccgatgtttctggataatatcgcctcgttcaatgccattagtggaattggtgtcaatgaatacttcagcagtattgaaactgagtttactgatacccttgaaggcaagcgccttaccgaattcttccagattgatttttttaataatacgctgacccagaaaaaaatcgggaattacaactatatcgttggagccgtcaataaggcagtaaatttgtataagcagcaacacaagactgtgcgtgtaccgcttttaaaaccattatacaaaatgattcttagcgaccgcgtcacgccctcatggctgcccgagcgctttgagagtgatgaggaaatgctgacagcgattaaggcagcctatgagtcgctgcgcgaggttcttgttggcgacaacgatgagagcttacgtaacttattacttaatattgagcattatgatttagaacacatctatattgctaatgactcaggccttacaagcatctcgcagaaaattttcggatgctacgatacctataccttggctatcaaagaccaattgcagcgtgattatcctgcgactaaaaagcaacgtgaagcccctgatttatacgacgagcgtatcgataagttgtacaaaaaggtggggagtttttcaattgcctaccttaatcgccttgttgatgcaaaaggacacttcaccatcaacgaatattacaagcagcttggggcctactgtcgcgaagaaggtaaagagaaagatgacttttttaagcgtatcgacggagcgtactgtgcgatcagccatcttttttttggtgagcatggtgaaattgctcagagtgattccgatgttgagctgatccagaaacttcttgaggcgtataaagggcttcagcgttttattaaacctcttttgggtcacggcgacgaagcggacaaagataacgagttcgacgcgaagcttcgcaaggtgtgggacgaattagacatcattacccctctgtatgataaggttcgtaactggcttagtcgcaagatttataatcccgagaaaattaaattgtgctttgaaaacaacggcaaattattatccggctgggttgattcccgcaccaaatccgacaatgggacgcaatatggtggctatattttccgcaagaagaatgagatcggggaatacgatttttatttaggaatctccgcagatacaaagttgttccgtcgtgatgccgctatcagctacgatgacgggatgtatgaacgccttgattattatcaattaaaatcgaagacgcttttgggtaattcttatgtcggcgactatgggttggattccatgaaccttttatcagcgttcaaaaatgctgctgtgaagtttcaattcgaaaaggaggtggtgcccaaggataaagagaacgttcccaaatatctgaagcgccttaagttagactacgccggtttttatcaaattttgatgaacgatgataaggttgtggatgcttataaaatcatgaagcaacacatcctggcaactctgactagttctattcgcgtaccggcagcaatcgaacttgcaacccagaaggagttaggaattgacgaattgatcgacgagatcatgaatcttccctccaagagtttcggatactttccaatcgtaacagccgccatcgaggaggcaaataagcgtgagaataaacctctgttcctgttcaagatgtcgaataaggacttatcatacgccgccacggcaagtaaaggtcttcgcaaagggcgtggcacggaaaacctgcatagcatgtatttgaaggcattgctggggatgacccaaagtgtttttgacattggctcaggtatggtatttttccgccaccagacaaaaggactggccgagacaacggcgcgtcacaaggcaaacgaatttgtcgctaataagaataaactgaatgataagaagaagtcgattttcggatatgagatcgtcaaaaacaagcgcttcacagtggataagtatttgtttaagttatcaatgaaccttaactactcgcaaccgaataataacaaaattgacgtaaacagcaaagtccgcgaaattattagcaatggcggcattaagaacatcatcggaatcgaccgcggtgaacgcaacttattatatttatcattgattgatctgaaaggaaatattgttatgcaaaaatctttgaatattttgaaagatgatcataatgccaaggagaccgattataaagggcttctgaccgagcgcgagggggagaataaggaggcacgccgcaactggaagaaaattgccaatatcaaggatcttaaacgtggttacctttcacaggtagtccatattatcagcaagatgatggtcgagtacaacgctattgtagttttagaggaccttaacccggggttcattcgtgggcgccagaaaatcgaacgtaatgtatatgaacagttcgagcgtatgctgattgacaagcttaacttctacgtggataagcataagggtgccaatgagaccggaggtcttctgcatgccttgcagttaacatcggaattcaagaactttaaaaagagtgaacaccaaaacggatgcttattttatatccctgcatggaatacgagcaaaatcgaccccgccacgggattcgtaaatctgtttaacaccaagtatacgaacgcagttgaggctcaggagttcttttcgaagttcgatgagattcgttacaatgaagaaaaagattggtttgaatttgagtttgactatgataagttcacgcagaaggcgcatggtactcgtaccaaatggaccctttgtacttacgggatgcgcttgcgctcgtttaagaacagtgccaaacaatacaattgggacagcgaggtagtcgccttaacggaagaatttaagcgtattttaggagaagccggcattgacattcacgaaaacctgaaggacgcgatttgtaacttagagggcaagtcgcaaaaatatttggaacctcttatgcagtttatgaaacttcttttacaattgcgcaattcaaaggctggaactgacgaagattatattttatctcccgtcgccgacgaaaatggtatcttctacgactcccgctcctgtggcgatcaattacccgagaacgccgatgctaatggggcttacaacattgcgcgtaaaggcttgatgctgattgagcagatcaagaatgctgaggacttgaacaacgtcaagttcgacatttcaaacaaggcttggctgaacttcgcacagcaaaaaccatacaagaatggctga

SEQ ID NO: 30 - DNA, 3846 bp, Artificial Sequence
  Description of Artificial Sequence: Synthetic polynucleotide
gtgaacatcttaaaggagaattatatgaaagagatcaaggagcttacagggctttactcactgacgaaaacaattggggttgaattaaaaccggtaggaaaaacacaagagcttatcgaagcgaaaaaattgatcgaacaggacgaccagcgcgcggaagattacaagatcgtaaaagacatcatcgaccgttaccacaaagatttcattgataagtgcttaaactgtgtaaagatcaaaaaggatgatcttgaaaaatatgtgtcacttgcagagaattccaatcgcgacgcagaggatttcgataaaattaaaaccaaaatgcgcaaccagattacagaagcgtttcgtaaaaattctttgtttacaaatttgtttaaaaaaaatcttattaaagagtacctgcctgccttcgtctccgaggaagagaaatctgttgtaaataagttcagtaagtttacaacgtactttgatgctttcaacgacaaccgcaaaaatttatatagcggggacgcaaaatctgggacgattgcatatcgcttgattcacgagaacttaccgatgtttctggataacattgcatcctttaatgccatttccgggatcggagtaaatgagtattttagcagcattgagacagagtttactgatacgctggaggggaaacgtcttactgagttcttccaaatcgacttctttaacaacacccttactcagaaaaaaatcgggaactacaactatattgtcggcgctgtgaacaaggcggtcaatttgtataagcagcagcataaaacggtccgtgtccctctgttgaagccgctttataaaatgattctgtcagaccgcgttactccctcatggcttcctgagcgctttgagtcggacgaagaaatgcttacggcaatcaaagcagcctatgaatcattacgtgaggttttggtcggtgataacgacgaaagccttcgtaacttgcttttaaatatcgagcattacgatttggagcacatctatatcgcgaacgattcgggattaacttctatctcccaaaagatttttggctgttatgacacgtatactctggccattaaggatcagcttcaacgtgactatccggccactaaaaagcaacgcgaggctccggacctgtacgatgaacgcatcgacaaactttacaagaaagtgggctcgttctcaattgcttaccttaaccgtcttgtcgacgcgaaaggacactttacgattaacgaatattataagcaacttggggcgtattgtcgcgaagagggcaaagaaaaggacgattttttcaagcgcattgatggagcttactgtgcgatttcgcaccttttctttggcgaacatggggaaatcgcgcaatcagactcggacgtcgaactgattcagaaattattagaggcgtacaaagggctgcagcgttttattaaaccattattagggcatggagatgaagcggacaaggacaatgaatttgatgccaaacttcgtaaagtctgggatgaacttgacatcattacgccgttatatgataaggtccgcaattggctttcccgcaaaatctataaccccgaaaagatcaagctttgctttgagaataacggtaagttattgtcagggtgggtagattctcgtactaaatcggacaacggcacacagtatggaggctacattttccgtaaaaagaacgaaatcggcgagtatgacttctatctgggaatttcagcagacacgaaattattccgtcgtgacgcggccatctcatacgatgatggtatgtacgagcgcttggattactatcaactgaaaagcaaaaccttactgggcaatagctatgtaggtgattacggattggacagtatgaacttgttgagtgcttttaaaaatgcggcggtaaagttccaatttgaaaaggaagtggtaccaaaagacaaagagaacgttccgaagtaccttaaacgccttaaattggactacgcgggattttaccaaatcttaatgaacgacgataaggtcgtggacgcttacaagattatgaagcaacatatccttgccaccttgacgtcttcgatccgcgttcctgcagcaattgaattggcaacccagaaagagcttggcatcgatgaacttatcgatgaaatcatgaatttaccaagtaagagttttggatactttcctattgtaaccgcggctattgaagaggccaacaagcgtgagaacaaaccgcttttcttgtttaaaatgagtaacaaagatcttagctatgcggcaacagcatctaaggggttacgcaagggtcgcggcacggaaaatttacactcaatgtatttaaaggcgctgcttgggatgacccaaagtgtctttgacattgggtctggtatggtttttttccgtcaccagaccaaaggcttagcggagactacggcacgtcacaaggctaacgagttcgtagcgaacaaaaataagttaaatgacaaaaagaaaagcattttcggatacgagatcgtcaagaataagcgcttcaccgtcgataagtacctgttcaaattgagtatgaacttaaattatagccagcccaacaataacaaaatcgatgtgaacagcaaagttcgtgagattattagtaatggcggcattaagaacattattggtattgaccgcggtgaacgtaatttgctgtacctgtctcttatcgatttgaaggggaacattgtcatgcaaaaatccctgaacatcctgaaagatgaccataatgcgaaagaaactgactacaagggtcttttaacagagcgtgaaggcgagaataaagaggcgcgtcgtaactggaagaaaatcgcaaatattaaggatttgaaacgtgggtatctgagccaagttgttcacattattagcaaaatgatggttgaatataacgcgattgttgtactggaagacctgaacccagggttcatccgcggacgtcagaaaatcgagcgcaatgtctacgaacaatttgagcgtatgttaatcgacaaattgaacttttacgtggataaacataaaggagcgaacgagacagggggcttgctgcatgcgctgcagttaacgtctgagttcaagaactttaaaaagagcgaacaccaaaacggctgtcttttctacatccccgcttggaatacgtccaagattgatccagcaaccggtttcgtaaacttgtttaacaccaagtataccaacgccgttgaagctcaggaattcttcagtaagttcgacgaaatccgctataatgaagaaaaagactggtttgagtttgagtttgattatgataagttcactcagaaagctcatggaactcgtaccaagtggactctgtgcacgtacgggatgcgcttacgcagcttcaagaactcagcaaagcaatataactgggactccgaggtagttgccttgaccgaggaatttaagcgcatccttggcgaggcaggaatcgatatccacgagaaccttaaggatgcgatctgcaacttggaggggaaatcgcaaaaatacttggaacctttgatgcagtttatgaagttacttctgcaattgcgtaactcgaaagccggaactgacgaagactatattctgagtccagtcgctgatgaaaatggtattttttatgactcccgttcctgcggagaccaattacccgagaatgctgacgcgaatggggcgtacaatattgctcgcaagggccttatgcttattgagcagatcaaaaacgcagaggaccttaacaacgtaaaattcgatatcagcaataaggcgtggctgaactttgcccaacaaaagccctacaagaacggctga

SEQ ID NO: 31 - DNA, 3882 bp, Unknown
  Description of Unknown: Parcubacteria group bacterium sequence
atggcaaaagagaatatttttaatgagctcacaggaaaataccagctttcaaaaacgttgagattggagttgaagccagtggggaacactcagcagatgcttaaagatgaagatgtctttgaaaaagatagaattatcagggagaagtatagagagacaaggccgcattttgatcgtttacatagagagtttattgaacaggcgcttaaaaatcagaaactttctgatttaggaaagtattttcaatgtctcgcaaaactccaaaacaataaaaaggataaagaagcgcaggaggaatttaaaaggatttctcaaaatttaagaaaagaagtcaatgatctatttaaaatagatccgctgtttggggaaggagtctttgctttgctaaaagaaaaatatggcgaaaaagacgatgctttcttaagggagcaagatggtcagtatgttcttgatgaaaataaaaagaagatatcaatctttgattcatggaagggatttacggggtatttcacaaaatttcaagagacaagaaaaaatttctacaaagatgatggtactgcgacggcagttgccacaaggatcatagaccaaaatctgaaaagattttgcgagaatattcaaatatttaaatccatacaaaaaaaagttgattttaaagaagttgaagataatttttcggtagatttagaagatatcttttctcttggtttttatagttcttgttttctccaggaaggaattgatgtgtataacaaaattctaggaggtgaaccaaaaacaacaggtgaaaaattaaggggattgaatgaattgataaacagatatcgccaggaccataagggcgaaaaattgccgtttttcaagatgcttgataaacagattttaagcgagaaagaaaaattcattgaaagtatagaagacgacgaagaacttttaaaaactctaaaggaattttattcttctgcggaagaaaagactacagtattaaaagagcttttcaatgactttattaaaaacaatgagaactatgatctttccgaaatctatatttccagagaagcactcaatactatttcgcaccgttgggtaagtgccgctacgctacctgaatttgaaaaaagtgtttacgaagtgatgaaaaaggacaaaccatcagggcttagttttgacaaggacgataactcttataaatttcctgattttatcgcgctctcttatataaagggatcgtttgaaaaattatccggagaaaagctatggaaagatggatattttagagacgaaacaagaaatggtgataaaggttttttgatcggcaatgaatccctttggactcaattcataaaaatatttgagtttgaatttaattctttatttgaggcaaaaaataccgaaagatccgttggttattatcatttcaaaaaagattttgaaaaaataatcaccaatgatttttctgtaaatccggaagataaagtaattatcagagaatttgccgataatgtgctggccatttatcaaatggcaaagtactttgccattgaaaagaaacggaaatggatggatcaatacgatacgggtgatttctacaatcatcctgactttggatacaagacaaaattttatgacaatgcctacgaaaagatagtaaaggcgagaatgttactgcaaagttatctcactaaaaaaccatttagcacggataagtggaagttaaattttgaatgcggatatcttcttaatggatggtcttcaagttttaacacctatggttcgcttttatttagaacgggcaatgaatactatttgggagttgtgaatggtagtgccttgcgaacagagaaaatcaagagactaacaggcaatataacggaggcaaattcttgtcataaaatggtttatgattttcaaaaaccggacaataaaaatgtaccaagaatatttattagatcaaagggtgataaatttgcaccagcggtctccgagttgaatcttcctgttgattcaatattagaaatatacgataagggtttgtttaaaacagaaaataaaaatagtccgttttttaagccatcacttaaaaagcttattgattacttcaaattgggattcagtcgccatgcatcctataagcactatcagtttaaatggaaggatagttctgaatataaaaatatatctgaattttataatgataccattcggtcttgctatcagatcaagtgggaggagttaaattttgaagaagttaaaaaacttaccaactcaaaagacttattcttattccaaatatataataaagatttttccgaaaaaagtactggaaataagaatcttcattccatttattttgatggtctattcttggataataatatcaatgcgcaagacggagtgatccttaaattaagtggtggcggagagatttttttccgaccaaagacagatgtcaagaaacttggtagcaggactgatactaaaggaaagcttgttataaaaaataagagatatagtcaagataaaatctttttacattttcctattgagctaaactattctaatactcaagagagtaattttaacaaattagtaagaaatttcctcgccgataatcctgatataaatattatcggtgttgatcgtggagagaaacatttgatttactacgcgggaattgatcaaaaaggaaataccttaaaagataaagacgataaagatgttttggggagcttgaatgagatcaatggcgtaaattactataagttattggaagaaagggcaaaggcgcgggaaaaggcccggcaggactggcagaatattcaaggcattaaagatttaaaaatgggctatatttctcttgtggtgagaaaattagctgatttgattattgagtataatgctattctcgtgcttgaagacttgaatatgcgatttaagcaaattcacggcgggattgaaaagagcgtgtatcaacagcttgaaaaagcgctcattgaaaaattaaatttcttagttaataaaggcgagaaagatccagagagggcggggcatttgctccgtgcgtatcagctgaccgcaccgtttagtacgtttaaggatatgggcaaacaaaccggcgtgctgttctacacgcaagccagctacacatcaaaaacgtgccctcaatgcggttttcgtccgaatattaaattgcattttgataatcttgagaacgcaaagaaaatgcttgagaagataaatattgtctacaaagataatcactttgaaattggctataaagttagtgatttcaccaagacagaaaagacaagtagagggaatatactatatggagacaggcagggcaaagacacctttgttatttcttctaaagcggcaatccgttataaatggtttgccagaaatataaaaaacaatgaactgaatagaggagaaagcttgaaagagcatacagaaaaaggagtaacaattcaatacgatattaccgaatgtttaaaaattctctatgagaaaaatgggatagatcattccggcgatataacaaaacaatcaatacggagtgaattgccagcaaaattttataaagatttactattctatttgtatttattgacgaatacaagaagcagtatctctggcacagaaatagattacataaattgccctgattgcggttttcatagcgagaaaggtttcaatggatgtatatttaatggagatgcaaatggtgcatacaatattgccagaaaaggtatgttaatactaaaaaagataaatcagtacaaagatcaacatcacacaatggacaagatggggtggggcgatttatttatcggtatagaggagtgggataaatatacgcaggttgtgtcaagatcataa

SEQ ID NO: 32 - DNA, 3882 bp, Artificial Sequence
  Description of Artificial Sequence: Synthetic polynucleotide
atggcgaaggagaacatctttaacgagcttaccggaaaatatcaactgtcgaaaactctgcgcttagaattaaaacctgtcggaaatactcaacaaatgttaaaagacgaagacgtgttcgaaaaagatcgtatcattcgcgaaaaatatcgtgagacccgtccccatttcgatcgtctgcatcgtgagtttattgaacaagcgctgaagaatcaaaaactttccgaccttggaaagtattttcagtgcttggctaagttgcaaaacaataaaaaggacaaagaggcacaagaagagtttaaacgcatttcgcagaatttgcgcaaagaagtcaatgatttattcaaaattgatccgttattcggcgagggtgtatttgcactgctgaaagaaaagtatggagaaaaagacgatgcctttctgcgcgagcaggacggccaatatgttttagatgagaataaaaaaaagatttccatttttgatagttggaagggctttacagggtatttcacgaaattccaggaaactcgtaagaacttctacaaagacgacgggacggcaacagcggtggctacacgtattatcgaccaaaatcttaagcgcttctgtgagaacattcaaatctttaagtcaatccagaagaaggtagactttaaggaggtcgaggacaacttctcagtcgatttagaagacatcttctctttagggttttactcttcttgtttccttcaggagggcatcgacgtatacaataagattctgggtggtgagccaaagactactggagaaaagcttcgtgggttgaacgagttgatcaatcgctatcgtcaggatcacaagggggagaaattgcctttttttaagatgctggacaagcagattctgtccgagaaagagaagtttatcgaaagcattgaagatgatgaggagctgttgaagaccttgaaggaattctatagtagtgccgaagaaaagactactgttctgaaagaacttttcaatgactttatcaaaaacaacgaaaactacgaccttagcgaaatctacatttctcgcgaagctctgaatacgatctcgcaccgctgggtgagtgcagccacacttccagagtttgagaaatccgtttatgaggtcatgaagaaggacaagccaagtggcctttccttcgacaaggacgataattcttataaatttcctgactttattgcgctttcgtacatcaaaggttcttttgagaaattaagcggagagaaactttggaaggatggctactttcgcgacgaaacccgcaacggtgataaaggatttcttatcggtaatgaatcattgtggactcaattcatcaagatttttgagtttgagtttaactcgttattcgaagccaagaacacggaacgttctgtggggtactaccattttaaaaaagattttgaaaaaattatcactaacgacttctccgtgaaccccgaagacaaagtgattattcgcgaatttgccgacaatgttcttgcgatctatcagatggccaaatactttgcgattgagaagaaacgcaagtggatggatcagtatgataccggcgacttctacaatcatccagactttggctacaaaaccaaattttatgacaatgcatacgaaaagatcgtcaaggcacgcatgcttttgcagtcatatttaacgaagaaacctttttcaactgataagtggaagctgaacttcgaatgtggctatcttttaaatggttggtcaagcagcttcaatacatacgggtcgttacttttccgtaccggtaatgaatattatttgggcgtcgtaaacggatccgccttacgtactgagaaaattaaacgtttaaccggaaatatcaccgaggcaaattcatgccataagatggtctacgatttccaaaaacccgataataaaaatgtccctcgcatcttcattcgttctaagggcgacaagtttgcccctgccgtatccgaattgaatttgccagttgattcaatcttagagatctatgacaaaggcctgttcaagaccgaaaacaaaaactccccattttttaaaccttcgcttaaaaaattgatcgactacttcaagttgggcttctcgcgtcacgcttcctataagcattaccaattcaagtggaaagattctagcgaatacaaaaatattagcgaattctataatgatacgattcgttcatgctatcagatcaaatgggaagagctgaatttcgaagaagtaaagaaattgaccaactcaaaggacctgttcttgttccagatctacaataaagatttctcagaaaagtccactggaaacaaaaacctgcacagtatctatttcgatggcttgtttcttgataataacattaacgctcaagacggcgtgattttgaaactgtccggtgggggagagattttttttcgccccaaaacggacgttaaaaagttaggctcccgcacggacaccaaaggaaagctggttattaagaataagcgctactcgcaagacaagatcttcttgcattttcctatcgagttaaactactcaaatacgcaagaatccaactttaataaactggtgcgtaattttctggccgataatccggatatcaatattattggtgtagatcgtggagagaaacatcttatctattatgcggggatcgaccagaaaggaaatacactgaaggacaaagatgacaaagatgtgttgggcagcttgaatgagatcaacggggttaattattacaaattacttgaagaacgcgcgaaagctcgcgaaaaagcccgccaagactggcagaacattcaaggtatcaaagaccttaagatgggctatatttcgttggtggtccgcaaactggcggatcttattatcgaatacaacgccattctggttttggaagacctgaacatgcgcttcaagcagattcacgggggaatcgaaaagtcagtatatcaacagcttgagaaagccttgatcgagaaattgaacttccttgtcaacaagggagagaaggaccccgaacgtgcggggcatcttctgcgcgcttatcaacttacagcccctttctccacctttaaggacatggggaagcagacaggcgtattgttctacacccaggcaagctatactagcaagacttgtcctcagtgtgggttccgtccgaatatcaagttgcactttgacaatttggagaatgccaagaaaatgcttgaaaaaatcaacattgtgtataaggataaccactttgaaattggatataaggtaagcgactttaccaagaccgagaagacttcccgcggtaacatcttgtatggtgatcgccaagggaaggacacttttgtgatcagttcgaaagctgctattcgttataagtggtttgctcgcaacatcaagaacaatgagttaaaccgtggggaatcgcttaaagaacataccgagaagggtgtcaccattcagtacgatatcacggaatgtcttaaaatcctttatgaaaaaaacgggatcgaccattccggtgatatcaccaaacaatctatccgctcggaacttcctgccaaattctataaggatcttcttttctacttgtaccttcttacgaacactcgctcttcgatttccggcaccgaaatcgactacattaattgtccggactgtggattccactcagagaagggttttaacggctgcatttttaatggtgacgccaacggagcatataatattgcccgcaaaggaatgcttattcttaaaaaaatcaaccaatataaagatcagcaccatactatggataaaatggggtggggtgatcttttcattgggattgaagaatgggacaagtatacgcaggttgtcagccgctcttaa

SEQ ID NO: 33 - DNA, 3882 bp, Artificial Sequence
  Description of Artificial Sequence: Synthetic polynucleotide
atggcgaaagaaaatatctttaacgaacttacaggaaaataccagttaagtaagacacttcgcctggagttgaagcctgttggaaatactcaacagatgttgaaagacgaagacgtatttgaaaaagatcgtattatccgcgagaaataccgtgaaacccgtccccattttgaccgtttacaccgtgagttcattgagcaagctttgaagaaccaaaagttgtctgaccttggtaaatactttcagtgccttgcaaaactgcagaataataaaaaggataaagaggcccaagaggaattcaagcgcatttctcaaaatttacgtaaggaagtcaacgatttgtttaaaatcgacccgctgttcggagaaggagtgtttgctttgttgaaagagaaatatggagaaaaggacgatgccttccttcgcgaacaggatggtcagtatgtgttagacgaaaacaagaagaaaatttctatctttgattcctggaaaggctttacaggatacttcacgaaatttcaggaaacccgcaagaacttctacaaggatgatggaactgctaccgctgtggcaacccgtattatcgaccaaaatctgaagcgcttctgtgaaaacattcagattttcaagtctattcagaagaaagttgatttcaaggaagttgaggacaatttttcggtagatttagaagacattttctcgttaggcttctacagctcgtgtttcttgcaggaaggtatcgacgtatataacaaaattcttggaggagaaccgaaaacaacgggggagaaactgcgcggtctgaacgaattaattaaccgctaccgtcaggaccataagggagagaaactgcccttttttaaaatgcttgacaagcaaattctttctgaaaaagagaaatttattgagtcaattgaggacgacgaagagttattgaagactttaaaggagttctattctagcgccgaagagaaaactacagtgttgaaggaacttttcaacgattttattaagaataacgagaactacgacttatcggagatttacattagccgtgaagcgcttaataccattagccatcgctgggtgagcgctgccacacttccggaatttgagaagtcggtgtacgaagtcatgaaaaaggacaaaccttccggtcttagttttgataaagatgacaattcctataaattccccgattttattgctttgagctatattaaggggtcgttcgaaaaactttctggagaaaagctgtggaaggatggatactttcgcgatgaaacgcgtaacggtgacaaggggttccttatcggcaatgaatccttgtggactcaatttattaagatttttgagttcgagttcaattcactgttcgaagccaaaaatacagagcgctctgtggggtattaccatttcaagaaagacttcgagaaaattatcacaaacgacttcagtgtcaaccctgaagataaggtgattattcgtgaattcgcggataatgtactggcaatctaccagatggccaagtatttcgctattgaaaaaaaacgtaaatggatggaccaatacgatacaggtgatttttataaccatccagactttggctacaagacgaaattttatgacaacgcgtatgagaagattgtaaaggcacgtatgttattacagagttaccttaccaagaagccgttctccacggataagtggaagttaaacttcgagtgcggctatttgcttaacggatggagttcatctttcaatacgtatgggtcgcttttatttcgtacaggtaatgaatactaccttggcgttgttaacgggtctgcgctgcgtacagagaagatcaagcgccttacaggtaacatcacagaagccaattcttgtcataaaatggtttatgactttcaaaagccggacaacaagaacgtgccccgtatttttatccgttccaagggagacaagtttgcaccggcggtgtccgagctgaacttgccagttgatagcattcttgagatctacgacaagggtcttttcaaaacagaaaacaaaaacagtcccttcttcaaaccaagtcttaaaaagttgatcgactattttaaacttggcttttcccgccatgcttcatataaacactatcaatttaaatggaaagatagctctgagtacaagaatatttctgagttctacaatgacacgatccgtagctgctaccagattaagtgggaagagttaaattttgaagaagtcaaaaagttaacgaatagtaaagatttgttcttatttcaaatttataacaaagatttcagcgaaaagtctaccggaaataagaacctgcactctatctattttgacggcctgtttctggataataacattaatgcacaggatggagtgattttgaaattaagcggagggggggaaatcttcttccgcccgaagacagacgtgaagaagctgggcagccgcactgatacaaaaggtaaattggttattaagaacaaacgttattcacaagacaaaatctttctgcacttccccatcgagttgaactactctaacacacaggagtctaatttcaataagcttgtgcgtaattttctggcagataatccagacattaatattatcggggtggaccgcggagagaagcatcttatttactatgcaggaatcgaccagaaaggaaatacgttgaaggataaggacgataaagatgtattgggctctcttaatgagattaacggcgtaaactactacaaactgcttgaggagcgcgctaaagctcgcgaaaaagcccgccaggactggcaaaatattcaagggatcaaagacttgaagatgggctatatcagtttggtagtccgcaagctggcagacttaattatcgagtataacgcaattctggtattagaagacttgaatatgcgctttaaacaaattcacggtggaattgagaagtcagtctaccaacaactggagaaggccctgatcgaaaaactgaactttctggtaaataagggggaaaaagaccctgagcgtgctgggcatcttttgcgcgcatatcaactgaccgctccttttagcacgtttaaggatatggggaagcagaccggggtactgttctatactcaggccagttatacatctaaaacgtgcccccaatgtggatttcgccccaacatcaagttgcactttgataacttggaaaatgcgaagaagatgttggagaaaattaatattgtatataaagacaaccattttgagattggctacaaggtgagtgattttactaagacagaaaaaacatcccgtggtaacatcttatatggagatcgccagggaaaagacactttcgtcatttcttctaaagctgctattcgttataaatggtttgcacgcaatattaaaaacaacgagttgaaccgcggtgaatccttgaaggagcatacggagaagggcgtcacgattcagtatgatattactgagtgcttgaaaatcctttacgaaaaaaacggcattgaccacagtggtgacatcaccaaacagagcatccgcagtgaattgccggctaagttttataaagatcttctgttctatttataccttttaactaatacgcgttcgtccatcagcggtaccgagatcgattatattaactgtccggattgtggtttccattctgagaagggatttaacgggtgcattttcaatggtgacgcaaatggcgcttataatattgctcgcaaggggatgcttattttaaaaaagattaatcaatacaaggatcagcatcatacaatggacaagatgggttggggtgaccttttcattggtatcgaggaatgggacaagtatactcaagttgtgtcgcgcagctaa

SEQ ID NO: 34 - DNA, 3882 bp, Artificial Sequence
  Description of Artificial Sequence: Synthetic polynucleotide
atggcgaaagagaatatttttaacgaattaacaggcaagtaccaacttagcaaaaccttacgtctggaactgaaaccggtaggaaacacgcaacaaatgttgaaagacgaggatgtcttcgagaaggatcgcattattcgcgagaaatatcgtgagacccgtccacatttcgaccgcttacatcgtgagtttatcgaacaagcgcttaagaaccaaaagttgtctgatttgggcaaatatttccaatgcctggcaaaattgcaaaacaataagaaggataaagaagcgcaagaagaattcaaacgcatttcacaaaatctgcgcaaggaagtaaatgacctgttcaagattgacccattattcggtgagggtgtattcgcattattaaaggaaaaatacggtgaaaaggacgacgcgttcctgcgcgagcaagacggccaatacgtattggacgaaaataagaagaagatttctatttttgattcttggaaagggtttaccggttacttcacaaaattccaagaaacacgtaaaaacttctataaggacgacgggaccgcaacagcagttgcgacacgtatcattgatcagaatctgaaacgcttttgcgagaatatccaaatcttcaaaagcattcagaagaaagtagattttaaagaggtcgaagacaacttcagcgtcgacttggaagacattttttccttggggttctacagctcgtgtttcttacaggaagggatcgacgtatataacaagattttagggggggaaccaaaaactacaggggaaaaattacgtggtttaaatgaactgattaaccgttaccgtcaggatcataagggtgagaagctgcccttcttcaagatgcttgacaagcaaattttatctgagaaggaaaaattcattgagtctattgaagacgatgaagaacttcttaagacgctgaaagaattctacagttccgcagaagaaaagacgactgtcttaaaagaactgtttaatgattttatcaaaaataatgagaattatgatctttctgaaatttatatttctcgtgaagccttaaatacaatcagccaccgctgggtatcggctgcaactctgccggagtttgagaaatctgtatatgaagtgatgaagaaagataaaccctcaggtctttcttttgataaggatgataattcgtataagttcccggattttattgccttatcgtacatcaagggaagctttgagaagctgtctggtgagaagttgtggaaggacgggtactttcgcgacgaaacgcgcaatggtgacaagggattccttattggaaatgagtcactgtggacacaatttatcaaaatttttgagtttgagttcaattcgttgtttgaagcaaaaaacaccgaacgttctgtaggatactatcactttaagaaggattttgagaagattatcaccaatgatttttcggtgaacccggaagacaaagtaattattcgcgaatttgctgacaacgtcttagccatctaccagatggctaaatattttgctatcgagaagaagcgtaaatggatggaccaatatgataccggggacttctataaccatcccgactttggctacaaaactaaattctacgataatgcgtatgaaaaaatcgtcaaggcacgtatgctgttacagtcctatttaactaaaaagccatttagtactgataaatggaagctgaacttcgaatgtggatacttacttaatggatggtcgtcttcatttaatacttacggctcccttctgttccgtacgggaaatgaatactatcttggtgtcgtcaatggctccgcccttcgcacggagaagattaaacgccttactggcaatattacggaagctaactcctgccataagatggtctacgatttccaaaagccagataataaaaacgttccgcgtatctttatccgttcaaaaggggataaattcgcacctgctgtatcagagctgaacttgcccgtcgactcaatcttagagatctacgacaagggactgtttaagacggagaacaagaactcaccgttcttcaaaccgtcgttgaagaagctgattgactactttaagctggggttcagccgtcacgcgtcatataaacactatcagttcaagtggaaagattcatccgaatacaaaaatatttccgagttctacaatgatacgattcgctcgtgttatcagattaagtgggaagaattaaactttgaggaagtgaagaagctgacgaactctaaagacctgtttcttttccagatctacaataaagatttttcagagaaaagcacgggaaataagaatcttcattccatttacttcgacgggctgtttcttgataacaacattaacgcgcaggacggtgttattctgaaattgtctggaggtggagagatctttttccgtccgaagaccgacgtcaaaaagctggggtcgcgcactgatactaaagggaaactggtgatcaaaaacaaacgttactcgcaggataaaatttttttgcactttcccattgaattaaattactcaaacacgcaagagtccaactttaacaagttggtccgcaactttttggctgataacccggatatcaatatcattggagtggaccgtggcgagaagcatttaatttactatgccgggatcgaccagaaaggcaatactctgaaggacaaagatgacaaagacgtccttggtagtttgaacgagatcaatggcgttaattattacaagttgttggaagaacgtgccaaggcccgtgaaaaagcccgccaagattggcaaaatatccaaggtatcaaggacttgaagatgggatacatctctttagttgtacgcaagcttgccgatttaatcattgagtataacgctatccttgttttagaagatttgaatatgcgcttcaagcaaattcatggtggaatcgaaaaaagcgtctatcagcaattggaaaaagccctgatcgaaaaacttaactttttagttaacaagggggagaaggatcccgaacgcgccggtcatttgttgcgtgcgtaccagttaacagcccccttcagcacttttaaagacatgggcaaacaaacaggcgttcttttttatacacaggcatcttatacatcgaaaacgtgcccgcagtgtggctttcgccccaatatcaagctgcattttgataatttagaaaatgccaaaaaaatgcttgaaaaaattaacatcgtctacaaggataatcacttcgaaattggctataaggtttctgatttcacgaaaaccgaaaagacaagtcgcggaaacattctgtatggtgatcgccaaggcaaagacactttcgtaatttcatctaaagccgccatccgctataagtggttcgcacgtaatatcaagaacaacgagttgaaccgcggagagagcctgaaggaacacactgagaagggagtaaccattcaatatgatattacagaatgtctgaagattttatacgaaaaaaacggtatcgatcactccggcgatattaccaagcaaagtatccgcagcgagctgcccgctaaattctataaggacttacttttctatttgtaccttcttacgaacactcgctcgtccatttccggcaccgagattgattatatcaattgcccagattgcggttttcattccgaaaagggatttaacggttgtatttttaatggcgacgcaaacggagcgtacaatatcgctcgcaagggaatgctgatccttaaaaagatcaatcagtataaggaccaacatcatactatggataagatgggctggggcgatttattcattggtattgaagaatgggacaaatacacacaagtcgtctcacgctcataa

SEQ ID NO: 35 - DNA, 3822 bp, Prevotella sp.
atgaaagaaattaaagaactaacaggcttgtattctttaactaagactattggggtagaattaaagccagtgggtaagacgcaagagctcattgaagctaaaaagcttattgagcaggatgatcagcgtgccgaagattacaaaatagtaaaggatattattgatcgttatcataaggattttatcgataagtgtcttaactgtgttaaaatcaaaaaagatgatttggagaaatatgtgtcattggcagaaaactctaatagagatgctgaggattttgacaaaatcaagaccaaaatgcgtaatcagataactgaagctttcagaaagaattctttatttactaatttattcaagaaaaatcttattaaggagtatcttcctgcttttgtaagtgaggaagagaagagtgtggtgaacaaatttagcaaatttaccacttactttgatgcgtttaatgacaatcgtaaaaatttatattcaggcgatgccaaatccggtacgatagcttatcgacttattcatgagaatttgccgatgtttcttgataatatagcatcctttaatgcaatttctgggataggagtaaatgagtacttttctagtatagagacagaatttactgatactcttgaaggaaagcgtctgactgagttttttcagattgacttttttaataatacattgactcagaaaaagataggcaactataactatattgtaggggcagtcaataaagctgtaaatctttataagcaacagcacaaaacagttcgtgttccattgctcaaaccattatataaaatgatcttgagtgatagagttactccgtcatggttacctgaacgttttgaaagtgatgaagagatgctgactgccatcaaagctgcttacgaatctttgagagaagttttagtaggtgataatgatgaaagtcttcgcaacttattgctcaatatagagcattatgatcttgaacatatttacattgcaaatgattccggattgacttccatttcacagaaaatatttggatgttatgatacttatactttggcaatcaaagaccaactacaaagggattatcctgcaacaaagaagcaaagagaagctcctgatttgtatgatgaacgtatagataaattgtataaaaaggtgggtagtttttctattgcttatcttaatcggttagtcgatgcgaaagggcattttactattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 36 - DNA, 3822 bp, Artificial Sequence
  Description of Artificial Sequence: Synthetic polynucleotide
atgaaagagattaaagaattgactgggttgtatagtcttacgaaaaccatcggagttgagttgaaacccgtgggaaagactcaagagttaatcgaggctaagaaattgattgagcaagatgatcagcgtgccgaggactataaaattgtgaaggatattattgaccgctatcacaaggattttattgataagtgtttgaattgtgtgaaaatcaaaaaggatgacttggagaagtatgtatctttagcggagaacagtaaccgtgatgcggaagactttgataagatcaagacaaagatgcgcaaccagatcaccgaggcattccgcaaaaattctttattcacaaatcttttcaaaaaaaacctgatcaaagaatatcttcctgcattcgtctctgaagaggagaaatcagtggttaataagttttcgaagtttacgacctatttcgacgcttttaatgataatcgcaaaaacttgtactccggtgatgctaaatctggaacgattgcctaccgtttaatccatgaaaatcttccaatgtttttagacaatatcgcctcgttcaatgccatttcgggtatcggagttaacgaatacttctcttctattgaaaccgaatttacagacacattagaaggaaagcgtttgactgaattttttcaaatcgatttctttaacaacactcttacacaaaaaaaaatcggcaactataattacatcgttggtgctgtgaacaaggcagtcaatctgtacaagcagcagcataagacggtccgtgtaccattacttaagcccctgtataagatgatcttatccgaccgcgtaacgccgtcatggttgccagagcgtttcgaatcggacgaagagatgcttacggctatcaaagcggcctatgaatccttacgtgaggtgttggtaggcgataacgacgagtccctgcgcaaccttttactgaatatcgaacattatgatttggaacatatctatatcgctaacgattctggccttacatctattagccagaagatcttcgggtgttatgacacttatactttagcgattaaagatcaattgcaacgtgactatcccgcaacaaagaagcagcgtgaagcgccagacttgtatgacgaacgcattgacaagttgtataaaaaagtcgggtctttttctattgcgtatttgaaccgcttggtagacgcgaaagggcactttaccattaacgagtattacaagcaattaggcgcatattgccgtgaagaagggaaggaaaaagatgacttctttaaacgcattgacggcgcctattgcgcgatcagccacctgtttttcggagagcatggggaaatcgcgcaaagcgattctgatgtcgaattaattcagaagctgctggaggcatataaggggcttcaacgctttatcaagccgttgctgggacatggggatgaagccgataaagacaacgaatttgacgcaaagttgcgtaaagtgtgggacgagttagacatcattacgcccttgtacgacaaggtccgcaattggctgagccgcaagatctataatcctgaaaagattaagttgtgtttcgaaaataatggcaagcttctgtcgggctgggttgactcacgcacaaaatcggacaacggaacacagtatggcggttatattttccgtaaaaaaaacgaaatcggggagtatgatttttatcttgggatctccgccgacaccaaattattccgtcgcgatgcggctatcagttatgacgatggaatgtatgaacgcctggactactatcagttaaaatccaaaactcttttaggtaatagttatgtcggcgattatggtctggatagcatgaaccttttaagtgcatttaagaatgcagccgttaagtttcagtttgagaaagaagttgtaccaaaagacaaagaaaatgttcccaagtatctgaaacgcttaaagttggactatgccggtttttaccaaattttaatgaatgacgataaagtggtagacgcgtataagattatgaaacaacacatccttgccacccttacctcttcaatccgcgtgcccgcggcaattgaattagctacgcagaaagagttggggattgacgaactgattgatgagatcatgaacttgccatcaaaatcattcgggtactttccgattgtgactgcagcgattgaggaagctaacaaacgtgaaaataaaccgcttttcctgtttaagatgagcaataaagatctgagctacgctgccacagcctcgaaggggctgcgtaaggggcgtggtacagaaaatttgcattctatgtatcttaaagccctgttggggatgacacagtctgtgttcgacattgggagtggaatggtattttttcgccaccagactaaaggtcttgctgagaccacggcgcgccataaagcaaacgagttcgtagcgaacaaaaataagcttaatgataaaaagaaatccatctttggatatgaaattgttaaaaacaaacgtttcacagtcgataagtacctttttaaactttcgatgaatttgaactactcacaaccaaataataataaaattgatgttaactcaaaggtgcgtgagatcattagtaatggcggtatcaagaacatcatcggcatcgaccgtggggagcgcaacttgttatatttaagtttaattgatttgaaaggaaacattgttatgcagaagtccttgaatatcctgaaggatgaccataacgccaaagagacggactataaaggcttattaacagagcgtgagggtgaaaacaaggaggcacgtcgcaattggaagaaaatcgcgaacattaaagacttaaagcgcggctacctgtctcaagtggttcatatcatctccaagatgatggtagagtacaacgcaatcgtggttttggaagacttgaacccagggtttattcgcgggcgtcagaaaattgagcgtaatgtttatgaacagttcgaacgcatgttaatcgacaaacttaacttctacgtggacaaacataagggagcgaacgaaacgggcggcttattgcacgcattgcagttaacatcggaattcaaaaatttcaaaaaatctgaacaccaaaatggatgcttattctacatccccgcgtggaatacgagcaagatcgacccggcgactgggttcgtgaacttgtttaatactaaatatacaaatgccgtagaagcccaagaatttttctccaaattcgacgaaatccgctataatgaggaaaaagactggttcgagttcgaattcgattacgataagtttacccagaaggcacacggaacccgcactaaatggacgctgtgcacctatggcatgcgtctgcgttctttcaaaaatagtgcaaagcaatataactgggacagcgaggtggtggcattgaccgaggaatttaagcgcattttgggagaagccggcattgatatccacgaaaacttaaaggatgctatttgtaatctggaaggaaaaagtcaaaaatacctggagcctcttatgcagttcatgaagctgttgctgcaacttcgtaacagtaaagctggaacagacgaagattatatcttatcaccagtcgctgatgaaaatggcattttttacgattctcgtagctgcggggaccaattgccggaaaatgcagacgctaatggagcctacaatatcgcccgtaaagggttaatgttgatcgaacaaatcaagaatgctgaagaccttaacaacgtaaagtttgatattagcaacaaagcgtggctgaattttgcccagcaaaagccctataagaatgggtga

SEQ ID NO: 37 - DNA, 3822 bp, Artificial Sequence
  Description of Artificial Sequence: Synthetic polynucleotide
atgaaggagattaaggaactgacgggactgtattcattgaccaaaactattggagtggaacttaagccagttggcaagacgcaagaattgattgaggccaaaaagctgatcgagcaggacgatcagcgcgctgaagattacaagatcgttaaagacatcattgatcgctatcataaagacttcattgataaatgtctgaactgcgttaaaatcaagaaagatgatttggagaagtatgtaagcttggctgaaaactctaaccgcgacgccgaggatttcgacaaaatcaaaacgaaaatgcgcaaccagatcacggaggcatttcgtaagaatagtctttttacaaacttattcaagaagaatcttattaaagaatatcttccagcgtttgtttcggaagaagagaagtcagttgtcaataaattctcgaaattcacgacgtatttcgacgcctttaatgataaccgcaagaacctgtactccggcgatgcaaaatcgggtacaatcgcgtaccgtttaattcacgaaaatttaccaatgtttttggacaacattgcgagtttcaacgccatctcaggtatcggagtaaatgagtactttagctctattgagacggaatttactgacaccttggagggtaaacgtctgacggaattttttcaaattgacttttttaacaatactttaacacaaaaaaagattggcaactataattacatcgtgggcgccgtaaataaagctgttaatttgtataagcagcaacacaagacagtgcgcgtgcccttgctgaagccattatataaaatgatccttagtgatcgtgtgactccgtcttggttacctgaacgtttcgaaagcgacgaggagatgttaacggcaatcaaggcagcttacgaatcactgcgtgaagttcttgtaggtgacaacgatgaatcgttgcgcaatttgcttctgaacatcgagcattacgacctggaacacatttacatcgcaaatgatagcggcttgacatcaattagtcaaaaaatttttggctgctacgacacatatactttggccatcaaggatcaacttcagcgcgactaccccgctacgaagaagcaacgtgaagctcctgatttgtacgatgagcgcattgataagttatacaagaaggtaggctcatttagcatcgcgtatcttaatcgtttagtcgatgccaaaggccacttcacgattaatgagtattataaacaattaggcgcatactgccgcgaggaaggaaaggaaaaggacgacttttttaagcgtattgacggtgcgtactgcgcaatcagccacttattttttggcgagcatggagaaattgctcaaagcgacagtgacgtcgaacttattcaaaaattacttgaagcgtataaaggtctgcagcgctttattaaaccgttactgggccatggtgatgaggcggataaagataacgagtttgatgccaagcttcgtaaagtgtgggatgagctggacattattaccccattatacgacaaggttcgcaattggttgtcacgtaaaatctacaaccctgaaaagatcaagttatgcttcgaaaataatgggaaactgttatccgggtgggttgattcgcgtacgaagagcgataacggcacccaatacggaggatacatcttccgcaaaaaaaacgagattggtgagtatgacttctatttaggtatcagcgccgacactaagctgttccgtcgcgacgcggcaatctcctatgatgatggtatgtacgagcgtcttgattattatcaattgaagagtaaaacattgcttgggaactcgtatgtgggtgattacggcttagacagtatgaatctgttaagtgcattcaagaacgcagccgttaagtttcagtttgaaaaggaggtggtaccaaaagataaggagaacgttcctaagtacttgaaacgtttgaaattagattacgcaggtttctaccagatccttatgaatgatgacaaagttgtcgacgcatacaaaattatgaagcagcatattctggctacactgacatcctcaattcgcgtaccggctgctattgagttagcgacgcaaaaagagttgggtatcgacgaattgatcgatgagattatgaacttgccttcaaagtctttcggatacttcccgattgtcactgcagctatcgaggaagccaacaagcgtgagaataaacctttgtttttgttcaagatgtccaataaagacttaagttatgccgcgactgcatcaaagggtcttcgcaaggggcgtggcacagagaaccttcactctatgtatctgaaagctctgttggggatgacacagtcggttttcgacatcggttcgggcatggtattctttcgccaccaaacaaaaggactggcagagacaactgcgcgccataaggcaaatgagttcgtcgcgaacaaaaataagttaaatgataagaagaagtctatcttcgggtacgaaattgttaaaaacaaacgttttactgtagacaagtacttgtttaaacttagcatgaacttaaactatagccaaccaaataataacaagattgatgttaacagtaaagttcgtgaaatcatctccaacgggggaattaagaacattattgggatcgaccgtggtgagcgcaacttattgtacctttcattgatcgatttaaaaggcaacatcgtgatgcaaaaatcactgaacatcttgaaggatgatcacaacgcaaaggagacagactacaaaggtttgctgactgagcgtgaaggcgagaacaaagaagcccgtcgtaattggaaaaagattgcaaatatcaaagacttgaagcgcggatacttgtcacaagtcgtacatatcatctctaagatgatggtcgaatataacgccattgtagtactggaggacttgaatccaggattcattcgtgggcgccaaaaaatcgagcgcaatgtctacgaacagtttgaacgcatgttaatcgataaactgaacttttacgtcgacaagcacaagggtgccaatgagacaggaggattgttacacgcacttcaattgacgagtgagtttaaaaactttaaaaaatctgagcaccaaaacggctgtcttttctatatccctgcgtggaatacgtctaagatcgaccccgccaccggatttgtaaatctgttcaacactaagtatacgaacgctgtggaggcacaagagttcttctcaaagtttgatgaaattcgttacaatgaggaaaaagattggtttgagtttgaatttgattatgacaaatttacacagaaggcccatgggacccgcaccaagtggaccctttgtacttacggaatgcgtctgcgtagcttcaaaaactccgcaaaacagtataactgggactccgaagtagttgcattaacagaggaatttaagcgtattttgggtgaagcaggaattgacatccatgagaatttaaaagatgccatctgtaatttagaaggtaagtcacaaaagtatttggaaccattgatgcagtttatgaaactgctgcttcaacttcgtaatagtaaggcgggcaccgatgaggactatattctgtctccagtcgcggatgagaatgggatcttttacgactcacgttcgtgtggcgatcaactgccagaaaatgccgacgctaacggggcctataatattgctcgcaagggtttgatgttgatcgaacaaattaaaaatgcagaggatcttaacaacgttaagtttgacatttctaacaaagcatggcttaattttgctcaacagaaaccgtacaaaaacgggtga

SEQ ID NO: 38 - DNA, 3822 bp, Artificial Sequence
  Description of Artificial Sequence: Synthetic polynucleotide
atgaaagaaattaaagaacttactggactttattcattgacaaagactattggtgtcgagttaaaacctgtaggcaagacgcaggagttgatcgaggcgaagaaattgatcgagcaggatgatcagcgcgccgaggactacaagatcgtaaaagacatcatcgatcgttaccataaagactttattgacaagtgcttaaactgcgttaagatcaagaaagatgacctggaaaagtatgtttccttggcagaaaactctaaccgcgatgccgaggactttgataaaatcaaaaccaaaatgcgtaatcagattaccgaggcatttcgcaaaaatagcctgttcacaaaccttttcaagaaaaacttgatcaaagaatatttacctgccttcgtatcggaggaggagaaatcggtcgtgaacaaattctcaaaattcactacgtattttgacgctttcaacgacaaccgtaagaacctttactcaggcgacgcgaaaagtggtactattgcttatcgcttgattcatgaaaaccttcctatgttccttgataatattgcttccttcaacgcaattagcggaattggggtgaacgaatacttttcgtctattgaaactgagtttacagacaccttggaggggaaacgtttgaccgaattttttcaaatcgatttctttaacaataccttaacccagaaaaaaattggtaactacaattacatcgtcggggctgttaacaaggccgttaatttatacaagcagcagcacaaaactgtccgcgtccccctgttgaagcccttatacaagatgatcctttcagatcgcgtaactccctcctggttgccagaacgtttcgaatcagacgaagagatgttgaccgcaattaaggccgcgtatgaaagtctgcgtgaggtgttggtcggtgacaacgacgagagtctgcgcaatcttttgcttaacattgagcattacgatcttgagcacatttacatcgccaatgattctggacttacttcaatttctcagaaaatcttcggctgttacgatacgtacactttagcgatcaaagaccaattacagcgtgactatcccgcaactaagaaacagcgtgaagccccggacttgtatgatgaacgcatcgacaagttatacaaaaaggtgggatcattctctattgcctatttgaatcgtttggttgatgccaagggtcattttacgattaatgagtactacaaacagttaggcgcttattgtcgtgaggagggtaaggagaaagacgacttcttcaagcgtatcgacggtgcatattgcgctatttctcatctgtttttcggggaacacggggaaatcgcacaatccgacagtgatgtggagttaattcagaagcttcttgaggcgtataaaggacttcagcgctttatcaaacctctgcttgggcacggcgatgaggccgacaaggacaacgagttcgatgctaagcttcgcaaggtgtgggatgagcttgacattattacgccgttatatgacaaagtacgcaattggttatcacgcaagatttacaaccctgaaaaaatcaagttgtgttttgaaaacaacggaaaacttttatctggctgggtcgatagtcgcactaagagcgataacggtacacaatacggcggctatatttttcgcaagaagaatgagatcggagagtacgatttctaccttggaatcagtgccgacacaaaattgtttcgtcgtgacgccgcaatcagttacgatgacggaatgtacgagcgcctggactactaccaacttaagtcgaaaacgttattgggcaatagttatgtgggggactacggccttgatagcatgaaccttctgtccgcgttcaagaacgcggcggtgaaattccaatttgaaaaagaagtagtgccgaaggataaggaaaacgttccgaagtatttaaaacgtcttaaactggattatgccggattctatcaaatcttgatgaacgacgataaggtagtagacgcttacaagatcatgaagcaacacatcttggctacacttacgtcctcaattcgtgtaccagcggcaatcgagttggcgacccagaaagagctgggtattgacgagctgatcgacgaaatcatgaaccttccatccaagtctttcggttattttcccattgtgacggccgctattgaggaagcaaataaacgtgaaaataagcctttgttccttttcaagatgtccaacaaggatctttcctatgcggcaacagcttcgaaaggcctgcgcaaaggacgtggcaccgaaaatcttcattcgatgtatctgaaggcattattagggatgacccagtctgtgtttgacattgggtcaggcatggttttttttcgccaccagacaaaggggcttgccgagaccactgcacgccacaaggccaacgagtttgtagcgaataaaaacaagttaaatgataaaaagaagtctatctttgggtacgaaatcgtaaaaaacaagcgtttcactgttgacaagtatctgttcaaactgtcaatgaacttaaattattcgcagccaaataacaacaagatcgatgtaaactccaaggtgcgcgagattatttccaatggtggaattaaaaacattattggaattgaccgtggagaacgcaaccttctttacttatcgttgatcgatttgaagggcaatattgtcatgcagaagtcactgaatatccttaaagatgaccacaacgccaaagaaactgactacaagggtcttttaaccgagcgcgagggtgaaaacaaagaagcgcgtcgtaattggaaaaaaattgctaatattaaagatttaaaacgcgggtacttaagtcaggtcgttcatatcatctccaagatgatggttgaatataatgcaattgtcgtcttagaggatctgaatccaggtttcatccgcgggcgccagaagatcgagcgcaatgtctatgagcagtttgaacgcatgttaattgataagttgaacttctatgttgacaaacacaagggagcaaatgaaactggcgggttgttgcatgcattacagttaacctctgaatttaagaacttcaaaaaatctgagcatcaaaatggctgtctgttttatatcccggcttggaatacgtcgaaaattgaccccgcaacgggattcgttaacctgtttaacacaaaatacacgaacgccgtggaagcccaagagttctttagcaagtttgatgagattcgttacaatgaggaaaaagattggttcgagtttgagttcgactacgataagttcacgcaaaaggcccacggcacgcgcaccaaatggacattatgcacatacggtatgcgcctgcgcagcttcaaaaacagtgcgaagcagtataactgggattccgaggtcgtcgcattgacagaagaatttaagcgtatcttgggcgaggcaggtattgatattcatgaaaacttaaaagatgctatctgtaaccttgaggggaaaagccagaaatacctggaaccccttatgcagtttatgaagctgcttttgcaattacgtaatagtaaggcaggtactgatgaggactacattctgtcgccggttgctgacgaaaatgggatcttctatgattcccgttcttgcggggaccagttaccagaaaacgctgatgccaacggtgcttacaacattgctcgcaaaggcttgatgcttattgaacagatcaaaaacgccgaggatttgaataatgtaaaattcgatatttctaataaggcatggctgaactttgcccagcaaaagccctacaagaatgggtga

SEQ ID NO: 39 - DNA, 3903 bp, Acinetobacter sp.
atgaattttcaaccattttttcaaaaatttgtacacttatatccaatttccaaaaccttacgttttgaactaatcccacagggtgcaacacaaaaatttatttcagaaaagcaagtattgttacaagatgaaatcagagcacgtaaatatcctgaaatgaaacaggcgattgacggctaccataaagactttatccaacgtgcgctgagcaatattgacagtcaagtatttgaacaggcattaaatacatttgaagatttatttctacgctctcaagcagaaagagcgacagatgcctataaaaaagattttgaaacagcacaaacgaaactaagagaattaatcgttcatagttttgaaaagggtgaatttaaacaagaatataaatccctttttgataagaatttaatcaccaatttattaaagccttgggtggaacaacagaatcaaataggtgacagcaactatacgtatcatgaagattttaataaatttactacctacttcttaggtttccatgaaaatcgtaaaaacatttatagcaaggatccccacaagactgcccttgcctaccgtttaattcatgaaaatttacctaaatttttagaaaacaataaaattctactcaaaatccaaaatgatcatcctagtttgtgggaacaactgcaaacactcaatcaaacgatgcctcagttgtttgatggttgggatttctcgcaactgatgcaggtgtcattctttagcaatacattgacccaaacagggatcgaccaatacaacaccatcattggcggaatttctgaaggtgaaaaccgtcaaaaaattcaaggtatcaatgaactgattaatttatataaccaaaaacaagataagaaaaatcgtgtcgcaaaacttaaacaactgtataaacaaattttaagcgaccgcagcaccctgtcttttttacctgaaaaatttgttgatgataccgagctatatcatgcgatcaatatgttctatttagaacatttacatcatcaaagcatgatcaatggtcactcttacacgttgctagaacgtgtgcaattactcatcaatgaattagccaactatgatttgagtaaagtttatttagcaccgaatcaactgagtactgtttcccatcaaatgtttggagattttggctatatcggtcgggcattaaattattattatatgcaagtcatacaacctgattatgaacagttattagcaagtgctaaaacaaccaaaaaaattgaagcgactgaaaaactaaaaaccatatttctggatacccctcaaagccttgtggtgattcaagctgccattgatgaatatattcaattacaaccaagcacaaagccacatacacaattgaccgactttatcatctctctactcaaacaatatgaaactgtagcggatgatcaaagcattaaagtcatcaatgtttttagtgatattgaaggtaaatatagctgtatcaaaggtttagtgaatacaaaatctgagtcaaaacgcgaggtattacaagatgaaaaactagcgactgatattaaagcttttatggatgccgtcaacaatgtcataaaattacttaaacctttttcactaaatgaaaagttggttgcaagtgtagaaaaggatgcacgtttttatagtgactttgaagaaatttatcagtcattattaatttttgtgccactttataacaaagtccgaaattacattactcaaaaaccgtatagcactgaaaagtttaaacttaattttaacaaaccgaccttactgagtggttgggatgccaataaagaagccgataatttaagtattttacttagaaaaaatggcaattattatttagcgattatggatactgccaaaggtgcaaataaagcctttgagcctaagacactgaaccagctcaaagtcgatgatacaactgattgctatgaaaaaatggtctataagcttttgtcaggaccaagtaaaatgttccctaaagcttttaaagctaaaaataatgaaggtaactattatccaactccagagttacttacttcttataacaataacgagcatttaaaaaatgataaaaatttcacattagcatcattacatgcctatattgattggtgtaaagagtatataaatcgcaatccatcttggcatcaatttaattttaaattttcacccactcaatctttccaagatataagtcaattttattcggaagtttctagtcagagttataaagttcatttccaaacgattccaagtgactatattgatcaattggtggctgaaggcaaactgtatctgttccaaatttataataaagacttttcaccaaatgctaaaggtaaagaaaatttacataccttgtattttaaagccttatttagcgatgagaatttaaaacagcctgtatttaaactcagtggcgaagcagaaatgttctatcgccctgcttcgctgcaattggcaaacaccaccatccataaggcaggtgaaccaatggcggccaaaaacccattgacgccaaatgccactcgtactttggcttatgacattattaaagatcggcgttttaccactgacaaatatttgctgcatgtacccattagtttaaattttcacgcacaagaatcaatgagtattaaaaagcataatgacttagtccgtcagatgattaagcataatcatcaagatctgcatgtaattgggattgatcgtggtgaaaagcatttactctatgtcagtgtgatcgacttaaaaggcaatattgtctaccaagaaagccttaacagcattaaatcggaagcgcagaattttgaaacgccttatcatcaattgttgcagcaccgtgaagaaggtcgagcgcaagcccgtacagcatggggcaaaattgagaatattaaagaactcaaagatggttatttaagtcaggtggtgcatcgtattcagcaattgattttaaaatacaatgcgattgtgatgttagaagacctcaattttggctttaaacgtggtcgttttaaaattgaaaaacaaatttatcaaaagtttgaaaaagccctgattcataaactcaattatgtggtcgataaatctacccaagctgatgaacttggtggtgtgcgtaaagcctatcaattgactgccccttttgaatcctttgaaaaattaggtaaacaatcaggcgtgttattttatgtccctgcttggaacaccagtaaaattgaccctgtgacaggctttgttgatctacttaaacccaaatatgaaaacttagacaaagctcaagccttttttaatgcctttgacagcattcactataatgctcaaaaaaactattttgaatttaaggtcaatttaaagcagtttgcagggctcaaagctcaagcggctcaagcagaatggacgatttgctcttatggtgatgaacgccatgtgtatcaaaagaaaaatgcacagcagggtgaaacagtcattgtaaatgtgactgaagaattaaaagtcctgtttgcaaagaacaacattgaagttgcacaaagtgttgaacttaaagagacgatttgtacccaaacacaggtcgacttctttaaacgcttgatgtggctgttacaagtattgttggcactgcgttatagcagcagtaaagataaactcgattatattttgtctcctgttgccaatgcacaaggtgagttttttgattcacgccatgcatcggtacaattaccacaagactccgatgcaaacggtgcgtaccatattgccttaaaaggtttatgggtgattgaacaacttaaagctgctgataatttggataaggtcaaacttgccattagcaatgatgattggcttcactttgcacaacaaaaaccatatcttgcttaa

SEQ ID NO: 40 - DNA, 3903 bp, Artificial Sequence
  Description of Artificial Sequence: Synthetic polynucleotide
atgaacttccaaccattttttcagaagttcgttcatttatatccgatctctaagacgctgcgttttgaacttatcccccagggggcaacacagaaatttattagtgagaaacaagtgttgttgcaggacgaaattcgcgcgcgtaaatatccggagatgaaacaagctattgatgggtaccataaggattttatccagcgcgcgctttcaaatatcgattctcaggttttcgaacaagcccttaacacgtttgaggatctgttcttgcgttctcaggctgaacgcgctactgacgcatacaaaaaggactttgagaccgcccagacaaaattacgtgaattgatcgtacatagctttgaaaaaggtgaatttaagcaggaatacaagtcattgtttgataaaaacctgatcacgaatttgcttaagccctgggtggagcaacagaatcagatcggagatagtaattacacgtatcacgaagatttcaataaattcacgacttattttcttggcttccatgagaaccgcaagaacatttactcaaaggatcctcacaaaacagctttagcataccgtcttattcatgaaaacttaccaaagtttcttgaaaataacaaaattttgctgaaaattcagaacgaccacccttcgctgtgggagcagttgcaaactctgaaccaaaccatgccgcaactgttcgatggttgggacttttcacaactgatgcaagtgtcattttttagcaatacccttacccaaaccggtatcgatcagtacaataccattattggcggtatcagtgagggtgaaaatcgccaaaaaatccaggggatcaacgagcttatcaacctgtataatcaaaagcaagacaagaaaaatcgtgttgctaagttgaagcagctttacaagcagattctttcagatcgctcgactttatcgtttttgccggagaaatttgtcgatgacaccgagttgtaccatgcgatcaatatgttttaccttgagcatttacatcaccagtcaatgattaacgggcatagctataccctgttagagcgcgttcagctgttaatcaatgagttggccaactacgatttatctaaagtttatcttgcacctaaccagctgtctactgtctcacatcaaatgttcggtgattttggttacatcgggcgcgcgcttaattattactatatgcaagttatccagcccgattacgaacagctgcttgcctccgcgaaaacgactaagaagatcgaggcgacggaaaagttaaagacgatcttcctggatacgcctcagagccttgtcgtaattcaagctgctattgacgaatatattcaattacagcctagcactaaacctcatacccaattgactgatttcatcattagtcttttgaaacagtacgagactgtcgcggacgatcagagtattaaagtcatcaacgtcttctcggacatcgaggggaagtattcgtgtattaaaggcttagttaatactaagagtgagtcgaagcgcgaggtcctgcaggacgagaaactggcaacggatattaaagctttcatggatgcggtcaataatgtcatcaaattgctgaagccattcagcttaaacgagaagttagttgcatccgtagagaaggatgcacgtttctactccgacttcgaagaaatctaccagtcacttctgatctttgtccccttgtacaataaggtacgcaattacattacccaaaaaccgtactctacagagaagttcaaacttaattttaataagcccactttattatcggggtgggatgcaaacaaggaagctgacaatttaagcatcttattgcgtaaaaacgggaactattatttggccatcatggatactgcgaaaggggccaacaaggcgtttgagccaaagacacttaatcaactgaaggtagatgacacgaccgattgctatgaaaaaatggtatataagctgttatcaggaccatctaagatgttcccgaaagctttcaaggctaaaaataacgaaggtaattactaccctacccccgagcttcttacatcatataataataatgagcatctgaagaatgacaaaaacttcacactggcatcattgcatgcatatattgactggtgcaaggagtacatcaatcgtaacccctcttggcatcaatttaacttcaaattttcccctacacaatccttccaggatatttcacaattttatagcgaagtgtcatctcagagttataaggtacactttcaaacaatcccctcggattatattgaccagctggtagcagagggtaaactttacttgtttcagatctataacaaggacttttcgcccaacgccaaagggaaagaaaatctgcataccctgtattttaaagcactttttagtgacgaaaacctgaagcagcctgtatttaagttgagcggtgaggcggaaatgttttaccgtccagcttctttacaattggcaaacaccacgattcataaagcgggtgaaccaatggccgcgaagaaccccctgacgccgaatgcgacccgtaccttggcgtacgatattattaaggaccgccgttttactacagataaatacttattacacgtccccatctctttaaatttccacgctcaggaatcgatgtcgattaagaaacacaacgatctggtacgtcagatgattaaacataatcatcaggatcttcatgttattgggattgatcgtggcgagaagcatctgttgtatgtcagtgtgattgatttaaaagggaatattgtttaccaagaatcccttaattcgatcaaatccgaggcgcagaattttgagaccccttaccaccaattgttacaacatcgtgaggaggggcgtgcccaagctcgcacagcctggggtaagattgagaacattaaagagttaaaagatggctacctttcacaagttgttcatcgtattcagcagcttattctgaagtacaacgcgatcgtgatgctggaggaccttaatttcggttttaaacgcggtcgtttcaaaattgaaaagcagatttaccaaaaattcgaaaaagccttaattcacaagctgaactatgttgtcgacaagtccactcaagcagatgaattagggggcgtccgtaaggcctatcaattgacggcgcccttcgagtcttttgaaaagttgggaaagcaaagtggtgtcctgttctatgtaccggcgtggaacacttcgaaaatcgatcccgtgacgggtttcgtagatttgcttaagccgaaatacgagaatttagataaagcacaggccttcttcaacgcttttgatagtatccattataatgcacaaaaaaattattttgaattcaaagtaaacttgaagcaattcgccgggttgaaagcgcaggccgcgcaggcggaatggacgatctgttcttacggtgacgagcgtcacgtgtatcagaagaagaacgcccagcagggcgaaacagtcatcgtgaacgttacggaagagttgaaagtccttttcgctaaaaacaacattgaagtggctcaaagtgttgaactgaaagaaactatctgtacccagactcaggtagacttctttaaacgcctgatgtggttgttacaggtacttctggcgcttcgttatagctctagcaaggataaacttgattacatcttgagtcctgtggctaacgcacaaggcgagttcttcgactcccgtcacgcttcagtgcagcttccccaggacagtgatgctaatggtgcgtaccacattgcgctgaaagggctgtgggtcatcgaacaacttaaagccgctgataacttagataaagtgaaactggcaattagtaatgatgactggttgcattttgctcaacaaaagccataccttgcctaa

SEQ ID NO: 41 - DNA, 3903 bp, Artificial Sequence
  Description of Artificial Sequence: Synthetic polynucleotide
atgaactttcaaccgttcttccagaaattcgtgcatttatatcccatctctaaaactttgcgttttgagttaattccgcaaggagccacacaaaagtttatcagcgaaaagcaagtgctgttacaagatgaaattcgcgctcgcaaatatccggagatgaagcaggcaattgacgggtatcataaagatttcatccagcgtgcccttagtaacatcgattcacaggtgttcgagcaggctttaaatacgtttgaggatctttttttgcgttcgcaagcggaacgcgcgactgacgcgtacaagaaagatttcgagaccgcacaaactaaacttcgcgaacttatcgtccactctttcgagaaaggcgagtttaaacaggagtataaaagcttgttcgacaaaaaccttattactaacttgttaaaaccatgggtcgaacagcagaaccaaattggggatagtaattatacttaccacgaagatttcaacaagttcacaacgtatttccttggctttcatgagaaccgtaagaacatctatagcaaggacccacacaagacagcgcttgcttatcgtcttatccatgagaacctgccaaagttcttagagaacaataagatcctgctgaagatccagaacgaccatccctctctttgggaacagttacagactcttaatcagacgatgccacaattgttcgacggttgggacttcagccaactgatgcaggttagcttcttttcaaatactcttacccagactggaattgatcagtataatactattattggtggaattagtgaaggcgaaaatcgccaaaagattcagggcatcaatgagctgatcaatctgtacaatcagaaacaggacaagaagaaccgcgttgctaaattgaagcaattatataaacagatcctttcagatcgttcaaccctgagttttcttccagaaaaattcgtagatgacaccgaattgtaccacgctattaacatgttctatttggagcacttgcaccatcaatcgatgattaatgggcactcatacacccttttagagcgtgtccaacttctgattaatgagcttgcaaactatgatttgtctaaggtatatctggctccgaatcaactgagcacggtttcccaccagatgtttggggatttcggatacatcggacgcgctttaaactactactacatgcaggtgattcaacccgactacgagcaactgttggcatctgctaagaccactaagaagatcgaagcaaccgagaaattgaagacaatcttcctggacaccccgcagtctctggttgtaatccaggccgctatcgatgagtacatccagctgcagccatccaccaagccacacacgcaattaacggacttcattatctccttgttgaagcaatatgaaaccgtggcagatgaccaatctattaaggtgatcaatgtcttctctgacattgaggggaagtacagttgcattaaagggttggttaacacgaagtcggaatccaaacgtgaggtcttgcaggacgagaagctggcgacggacattaaagcatttatggacgccgtaaataatgtgatcaaacttttaaagcctttttcgttaaatgaaaaactggtcgcttctgtagagaaggatgcccgcttttattcggactttgaggaaatctatcaatctttgctgatctttgttcccttatacaataaggtacgcaattatattacccagaagccctactccactgagaagttcaaacttaacttcaataagccaactttattaagtggttgggatgcgaataaagaggcggataacttatcgatcttactgcgtaaaaatgggaactattacttggccatcatggatacagcgaaaggagccaacaaggctttcgaacccaaaacacttaaccaactgaaggtcgacgatactacagattgttacgaaaaaatggtctataaattattgtctggcccatccaagatgttcccaaaagcatttaaggcgaaaaacaatgagggaaactattatccgaccccggagcttttgacttcctataacaacaatgaacatctgaaaaacgacaaaaattttacgctggcgtccttgcatgcgtatattgattggtgcaaagagtatatcaatcgcaatccgagttggcatcaattcaattttaagttctcgcccactcaaagcttccaagacatttcgcaattctactccgaggtttctagccagtcgtataaagtccacttccaaaccatcccgtccgactacattgatcaattggtcgccgaagggaaactttaccttttccaaatctataataaggatttctctccaaacgctaaagggaaagaaaatctgcacaccttatactttaaagcgctgttctcagacgagaacttgaagcaacccgtatttaagctgagtggagaggcggagatgttttaccgtccggctagcctgcagttggcaaacacgacgattcataaggcaggggaaccaatggcggccaagaacccgctgacaccgaacgcaactcgtacgctggcatatgatatcatcaaggatcgtcgcttcacgacagacaagtacctgcttcatgtacctatctcgcttaatttccacgcgcaggaatccatgtctatcaaaaagcacaacgatttggtccgccagatgattaaacataatcatcaggatttgcatgtaatcggtattgatcgtggtgagaagcatttgttatatgtctctgttattgacttgaagggaaacattgtttatcaagagtcgttaaattctatcaaaagcgaggcgcaaaactttgaaactccctaccaccaacttcttcagcaccgcgaggaaggacgtgctcaagcccgtacggcatggggcaaaatcgagaatatcaaagagttgaaggacggttatctgtctcaggtcgtacatcgtattcaacagcttattctgaagtataacgcaattgtaatgttagaggaccttaatttcgggttcaaacgcggtcgcttcaaaatcgaaaaacaaatttaccaaaagttcgagaaggccttgattcataagctgaattacgtcgtagacaagagtactcaagcagatgagttggggggggttcgtaaggcttatcaactgacagccccttttgagtccttcgaaaaattagggaagcaatcgggtgttctgttttacgttccggcctggaacacctctaaaatcgaccctgtgactggtttcgtagatttgttaaagccaaaatatgaaaatctggacaaagcacaggcgttcttcaacgccttcgacagcattcattataatgcacaaaagaactatttcgaatttaaagtaaatttaaaacagttcgccggtctgaaggcacaggctgcacaagcagaatggactatttgctcatatggggacgagcgtcatgtctaccaaaagaaaaacgcccagcagggtgaaaccgtgatcgtgaacgtcactgaggagttaaaggtgctttttgctaagaacaacattgaggtcgctcagagtgttgagttgaaggagaccatctgcacacaaactcaggttgatttctttaagcgtcttatgtggttgcttcaagtcttacttgctcttcgttactcgtcctcgaaggacaaacttgactacatcttgtcgcctgtagcaaatgcccagggcgagttctttgattctcgtcacgcgtcggttcagttgccgcaagactcagatgcgaacggcgcgtatcacattgcgctgaaaggattgtgggtaatcgaacaactgaaagcggcagataaccttgacaaggtcaagcttgcaattagtaacgatgattggctgcatttcgctcaacagaagccgtatttagcgtaa

SEQ ID NO: 42 - DNA, 3903 bp, Artificial Sequence
  Description of Artificial Sequence: Synthetic polynucleotide
atgaactttcagccgttctttcagaagtttgtccatctgtatcctatcagcaaaacacttcgtttcgaattgatcccacaaggggcaacgcaaaagtttatctccgagaaacaggtacttctgcaggacgagatccgtgctcgtaaatatcctgaaatgaagcaagctattgatggataccacaaagacttcatccaacgtgccttgtcaaatattgatagccaagtctttgaacaagctcttaatacatttgaagatttattccttcgcagtcaagccgaacgtgctactgatgcgtacaagaaggatttcgagaccgctcagacaaaattgcgtgaacttatcgtgcatagttttgaaaaaggcgaatttaagcaagagtataaatccctttttgataaaaatttaattaccaaccttttgaaaccatgggttgagcagcaaaaccaaattggcgactctaactacacctaccacgaggacttcaataagtttacgacttatttcttggggtttcatgagaatcgcaagaatatctattctaaagacccacacaagactgcacttgcgtatcgcctgattcatgagaacttgcctaaattcctggagaataataaaatccttctgaaaattcaaaatgaccatccaagcttatgggagcaactgcagacattaaaccagactatgccccaactttttgacggttgggatttcagtcaattgatgcaagtatccttttttagtaacactttgacacagactggcatcgaccaatacaatacaattatcggcggcattagtgaaggtgagaaccgtcaaaagattcagggtatcaatgaacttatcaacttgtataaccaaaaacaagataagaaaaaccgtgtcgccaaattaaagcaattgtataaacaaattctgtccgatcgttccacgctgagctttcttcctgagaagtttgtagacgatacggaattgtaccatgctattaatatgttttacctggaacatttacaccatcaatcgatgatcaatgggcacagctacaccctgttagaacgcgtacagttgcttattaacgagcttgctaattacgacttatcaaaggtatatctggcccccaaccaactgtcaactgtgtcccaccaaatgtttggtgatttcggctatatcggacgcgccttgaattattattacatgcaagttattcaaccagattatgaacaactgctggcgtcggctaaaacaacgaaaaagatcgaggccacggagaagcttaagacaatttttttagacactccacaatcattggtcgtgattcaggctgcgatcgatgagtatattcagcttcaaccgtctaccaaaccgcatacgcaacttacggattttattatctcattgttaaaacaatatgagacagtcgccgacgatcagtctattaaagtcatcaacgtcttttccgatattgagggtaaatactcgtgtattaagggattagtcaacacaaagtcggagagcaaacgcgaggtattgcaagacgagaaattggccactgacattaaagcctttatggatgctgtaaataatgttatcaagctgctgaaaccattcagtcttaatgagaagttggttgcttctgtcgaaaaggatgctcgcttctactcggacttcgaagagatctatcagtcattactgatcttcgttcctctttataataaggtgcgtaattacatcactcaaaaaccatacagtactgagaagtttaagttgaattttaataaacctactttattatcgggctgggatgcaaataaggaagccgacaacttgagcatcttgcttcgcaagaacgggaattattatttagcaatcatggacaccgcaaagggggccaacaaggcattcgaacccaaaactttgaaccagctgaaagttgatgacacaacagactgctatgagaagatggtatacaagcttctgagcgggccctcgaaaatgtttcccaaagccttcaaagccaaaaacaatgaaggtaactattatccgactcctgagcttttgacaagttacaacaacaacgaacatttaaaaaatgacaaaaatttcacgttggcgtctctgcatgcatatatcgattggtgtaaggagtatatcaaccgtaacccatcgtggcaccaatttaatttcaagttctcacctacacagtcattccaagatattagtcagttttatagcgaggtctcaagtcaatcgtacaaagttcattttcaaacaatccctagtgattatatcgatcagctggtcgcagagggcaaattatatcttttccagatctataacaaggactttagccctaatgcgaagggaaaagagaatctgcacactttatactttaaagctttgttttccgatgagaatttaaaacagcctgtattcaagttgagtggggaagccgaaatgttttatcgtcctgcatcgttacaattggcaaataccacaattcataaggctggcgaaccaatggctgccaaaaaccccctgactccgaatgccactcgtacgcttgcatatgatattattaaggaccgtcgttttacaaccgataaatacctgcttcacgtaccgatttctttaaacttccatgcacaggagtcgatgtcgattaaaaagcataacgacctggtacgccagatgatcaaacacaatcatcaggacttacacgtaattgggatcgaccgcggagaaaagcacttgttgtatgtctctgtaattgacttgaaagggaatatcgtctatcaagagtccttaaactcgattaagtcagaagcgcaaaactttgaaaccccctatcaccaacttttgcaacatcgtgaagaggggcgcgctcaggcccgcactgcctggggaaagatcgaaaacatcaaggaattaaaagacggctacctgtcccaagtggtgcatcgtatccaacaacttatcttaaagtacaacgctattgtcatgttggaagatttaaactttggcttcaagcgtggacgctttaaaatcgagaaacagatttatcagaagtttgaaaaggctctgattcataaattgaattatgtggtagacaagtcaactcaagccgatgaacttggcggtgtgcgtaaggcataccaattaaccgcaccgtttgagagtttcgaaaagttgggaaaacaatccggcgtcctgttttacgtccctgcgtggaacaccagcaaaatcgatcctgtcaccgggttcgtggaccttttgaagcccaaatacgaaaacttggacaaggcacaggccttcttcaatgctttcgattcaatccattacaacgctcaaaagaactattttgagttcaaggtcaatctgaaacaattcgcagggcttaaagcacaagcagctcaagctgaatggactatctgctcgtatggggacgaacgtcacgtttatcagaagaagaatgcacaacagggggaaacggtcatcgtcaatgttaccgaagaattgaaagttttatttgctaaaaacaacattgaagttgcacaatcagtagagcttaaagaaaccatctgcacgcaaacgcaggtcgactttttcaagcgtcttatgtggcttctgcaggtactgttagcactgcgttactcttctagcaaggataaactggattatatcctttcccccgtagccaatgcacaaggagagttcttcgactcacgccacgcatcggtacaattaccgcaagacagtgacgcaaatggtgcgtaccatatcgccctgaagggtttatgggtcatcgagcaactgaaagctgccgacaatttagacaaggtcaaattagcaatttcgaacgacgattggttgcacttcgcacagcagaaaccttatttagcataa

SEQ ID NO: 43 - DNA, 3618 bp, Pseudobutyrivibrio xylanivorans
atgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtatcttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgatttaa

SEQ ID NO: 44 - DNA, 3618 bp, Artificial Sequence
  Description of Artificial Sequence: Synthetic polynucleotide
atgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttgtttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatctaa

SEQ ID NO: 45 - DNA, 3618 bp, Artificial Sequence
  Description of Artificial Sequence: Synthetic polynucleotide
atgtactatcagggactgactaagctttatcccatctcgaaaacgattcgcaatgaattgatcccagtcgggaaaacgttagagcatatccgtatgaataatattcttgaagcagacatccagcgcaagtccgattacgagcgtgtgaaaaaattaatggatgattatcataaacaattaatcaatgagtcgttgcaggatgtgcatttgtcatacgtggaggaagcggctgacctttacttaaatgcttctaaagataaggatatcgttgacaagttcagcaagtgccaagataaattgcgcaaggaaatcgtgaacctgctgaagagccatgagaattttccgaagatcgggaataaagagattattaagcttttgcaaagcctttccgatacggaaaaagattacaatgcgttggactcgttctcgaagttttatacctactttacctcatataatgaagtacgcaaaaatctttattcagatgaagaaaagtctagtacggctgcctatcgtctgatcaatgaaaatcttccaaagtttctggacaatattaaagcttactcaatcgccaagtcggcgggagtgcgcgcgaaggaattgacagaggaggaacaagactgtttgttcatgacggaaacctttgaacgcactcttacgcaagacgggattgacaactacaatgaattgatcggaaagctgaactttgccattaatttgtataatcagcaaaacaacaagcttaaaggtttccgtaaagtccctaagatgaaggagttgtacaaacaaatccttagcgagcgtgaagcatcctttgtggatgaatttgtagatgacgaggccttgttgaccaatgtggaatcgttctcagcacacattaaggagtttttagaatccgactcactgtcccgttttgctgaagttttggaagagagtgggggggaaatggtttatattaagaatgatacctctaagacgactttttcgaatatcgtctttgggtcatggaatgtgatcgacgagcgtttggccgaggagtacgatagtgccaattccaaaaaaaaaaaagacgaaaagtattatgataaacgtcacaaagaacttaagaagaacaaatcctattccgtagagaagattgtgtcactgtctacagaaactgaggatgtaattggaaagtacattgagaagcttcaagccgatatcatcgctatcaaagagacccgtgaagtgtttgaaaaagtcgtcctgaaagaacacgataagaacaaatcactgcgtaagaacacgaaagctatcgaagctattaagtcgttccttgacactatcaaggacttcgaacgtgatatcaaattaatctcgggttcagaacacgaaatggaaaaaaatttagcggtttacgctgaacaggaaaatattttaagcagtattcgtaacgtcgactcattatacaacatgtcgcgcaattaccttactcaaaaaccattttccacggaaaaatttaagttgaatttcaatcgtgccacccttttaaatggttgggacaagaataaggaaacggataaccttggaattttactggttaaggagggaaagtattatttgggcatcatgaacactaaggctaacaaaagcttcgttaacccgcccaagccgaagacagataatgtataccacaaagttaattataaactgttgccaggtccgaataagatgcttcccaaggtgttcttcgccaaaagcaacctggagtactacaagccgtctgaggatcttcttgctaaatatcaggctggcacgcataagaagggcgaaaattttagcttagaagactgccacagcctgatttcattcttcaaggacagtttggaaaagcatcctgattggtcagagtttggatttaaattttcggatacaaaaaaatacgacgacctttcgggtttctaccgtgaggtagaaaaacaaggatataagatcacatataccgatatcgacgtagagtacatcgactccttagtagagaaagacgagctgtatttattccagatttacaataaggacttttcaccatactctaaagggaattataatctgcacaccttgtaccttacaatgttattcgacgaacgtaatctgcgcaacgtggtatacaagctgaatggggaagcggaagtattttatcgccccgcttcaatcggtaaagacgaattaattatccataagtcaggggaggagatcaagaataagaatcctaaacgtgctattgataagcccacatccacgttcgagtatgatattgtaaaggaccgccgctatacaaaggataagtttatgttacatatcccggttaccatgaacttcggtgtggacgagactcgccgtttcaatgaggtcgttaatgacgcaattcgtggtgacgataaagtccgtgtcattggaatcgatcgcggagaacgtaatttattgtacgtggtcgtagtggactccgatggaacaattttggaacagatctctcttaattcgatcatcaataatgaatacagtatcgagacggactaccacaaattacttgatgaaaaggagggtgatcgcgaccgtgctcgcaagaactggacaacgattgagaatatcaaagaactgaaggagggttatctttcgcaggtcgttaatgtgatcgcaaaattggtattaaaatacgatgcaatcatctgcttagaagatttgaatttcggtttcaaacgcggacgccaaaaagtcgagaagcaggtctaccagaagtttgaaaagatgttaatcgacaaattgaattaccttgtaatcgataaatctcgttcacaagaaaatccagaagaagttggacacgttctgaacgcgttacaactgacaagcaaatttacaagctttaaagagcttgggaaacaaactggtatcatctattatgttccagcctatttgacatccaagatcgatccaactactggtttcgcgaacttgttttacgtcaaatatgagtcagtggaaaagtcaaaggattttttcaatcgctttgatagtatttgctttaacaaagtggccggctatttcgaatttagctttgattacaagaacttcactgaccgtgcttgcggtatgcgttcgaagtggaaagtgtgtactaacggcgagcgcatcatcaaatatcgtaacgaagagaagaactcctccttcgacgacaaggtcatcgtccttaccgaagaatttaaaaaattgtttaatgaatatggtattgctttcaatgattgtatggacttgacggatgcaattaacgctatcgacgacgcgagcttcttccgtaaattgaccaaattatttcagcagacgctgcaaatgcgcaacagcagtgctgatgggtcgcgtgattacatcattagtccggtcgagaacgataatggggagtttttcaactctgaaaaatgcgacaagtcaaagcctaaggacgcagatgccaatggagcgtttaacattgcccgtaagggtttgtgggtgctggagcaattatacaacagtagctctggggagaagctgaacctggcaatgactaatgccgagtggttagagtacgcgcaacaacacactatctaa

SEQ ID NO: 46 - DNA, 3618 bp, Artificial Sequence
  Description of Artificial Sequence: Synthetic polynucleotide
atgtattaccagggcttaactaagttatatccgatctcaaagaccattcgcaatgagttgattcccgtaggcaagacacttgaacacatccgcatgaataacattcttgaagcagacatccaacgcaaatcggattacgagcgcgtaaaaaagttgatggatgattatcacaaacaattaatcaacgaatctcttcaggacgtacacttaagctacgtggaagaggctgcagatctgtaccttaatgccagtaaggacaaagatattgtagataaattctcgaaatgtcaggacaaacttcgtaaggagatcgtaaatttgcttaagtcacacgaaaacttcccaaaaatcggtaataaagaaatcatcaagctgcttcaatctcttagcgacacagaaaaagattacaatgctttggactcgttttctaagttctacacatatttcacgagttacaatgaagtacgcaaaaatttatacagcgacgaagagaagagcagcaccgcggcatatcgcttgatcaatgagaatctgcccaaatttttagataacatcaaggcttattcgattgctaagtcggcaggggttcgcgcgaaggagcttacagaagaggaacaggattgtctgtttatgacagaaaccttcgagcgtactctgacacaggatgggattgacaactacaacgaattaatcggaaaacttaattttgcgattaacctgtacaatcaacaaaataacaagctgaagggcttccgtaaagtgcccaagatgaaagaactttataaacaaatcttgagtgagcgcgaggcatctttcgtggacgaatttgttgacgatgaggccttgctgaccaatgtggagagcttttctgcccacatcaaggagttcctggaatcagatagtcttagtcgctttgcggaagttcttgaggaaagcgggggtgagatggtatacattaaaaatgatacatctaaaactactttcagcaatatcgtgtttgggtcgtggaacgtcatcgacgagcgcctggcagaagaatacgacagcgctaattcgaaaaaaaaaaaagatgagaaatactatgacaaacgccacaaagagctgaaaaaaaataaaagctatagtgtcgaaaaaattgtctctctgtctaccgaaactgaagatgttattggtaaatatattgaaaaactgcaagctgatatcatcgcaatcaaagaaacccgtgaggtattcgagaaagtcgtactgaaggaacatgacaagaacaagtctcttcgtaagaacaccaaagccattgaagccattaagtcattccttgacactatcaaggattttgaacgtgacattaaactgatcagtgggagcgaacacgagatggagaaaaacttggccgtctatgccgaacaagaaaatattttaagttcaattcgtaacgttgattccctttacaatatgtcacgtaactatttgacacaaaagccgttttcaacagaaaagttcaagttgaactttaaccgcgcaacattacttaatggatgggacaagaacaaagagacggataatcttggcatcctgctggtcaaagaaggcaaatattatttgggtattatgaatactaaggcaaataaatcattcgttaacccccctaagcctaaaaccgacaacgtgtatcataaggtgaattacaagttattacctggccccaacaaaatgctgccgaaagttttcttcgcaaagtctaatttggagtactacaaaccttctgaagatcttctggctaaatatcaggcgggaacccacaaaaaaggtgaaaattttagcttggaagattgccacagtttaatttccttttttaaggattccttagaaaaacacccagattggtccgaattcggcttcaaattttcagatactaagaagtatgacgatctgtcgggcttctaccgcgaggtggaaaaacaagggtacaagattacttatacagatatcgacgtcgagtatattgactctttggttgaaaaggacgaactgtatctttttcagatctacaacaaagactttagtccttacagtaagggcaactacaaccttcatactttatacctgacaatgcttttcgacgaacgcaatcttcgtaacgtggtttataaattgaatggcgaggcagaagtgttttaccgcccggcgtctattggaaaggacgagcttatcatccataagtccggggaagagatcaagaataagaaccctaagcgcgctattgacaaaccgacatccacgtttgaatacgatattgttaaggaccgccgctacactaaagacaaattcatgttgcatattccggtcaccatgaattttggggttgatgaaacacgtcgtttcaatgaagtagtaaacgatgctatccgcggagacgataaggtacgcgtcattggaattgatcgcggagaacgcaatctgttatacgtagttgtcgtagactcagatgggaccattctggagcagattagcttgaacagtattatcaacaacgagtattcaattgagaccgattaccataaactgttagatgaaaaagagggtgatcgtgatcgtgcgcgcaagaattggacgactatcgaaaatatcaaggaattaaaagagggatacctgtctcaggtagtaaatgtgattgctaagttggtgctgaaatacgacgctatcatctgcttggaggatcttaacttcggtttcaagcgtgggcgccaaaaggtcgagaaacaggtctaccaaaagtttgaaaaaatgttaattgacaaattgaactacttagtgattgataaatcacgctcacaggaaaacccagaggaagttggacacgttttaaacgccttacaactgacgagtaagtttacctcttttaaagaattaggtaaacagacgggcatcatttattatgtccctgcctacttaaccagtaagatcgatccgacgacaggatttgctaatcttttctatgtcaaatacgaaagcgtagaaaaaagtaaagatttctttaaccgcttcgactccatttgcttcaataaagtagccggctacttcgaattttcgttcgactacaagaactttaccgaccgcgcgtgcggtatgcgtagcaaatggaaggtttgcacaaatggtgagcgtatcatcaagtatcgcaacgaagaaaaaaacagcagctttgacgataaggtgatcgtgttgacggaggaatttaagaagctgttcaacgaatatggtattgctttcaatgattgtatggacttgacggatgccattaacgcaattgacgatgcaagcttttttcgtaagttgactaaattgtttcaacaaactctgcaaatgcgtaattcttcggcagacggttctcgcgattacattatttcgccggtagagaatgataacggcgaattcttcaattcggaaaagtgcgacaagagcaaacctaaggatgcggatgcgaacggggccttcaacatcgcccgtaaagggttgtgggtgctggagcaattatacaatagttcatcaggagagaaacttaatctggcgatgactaatgctgagtggctggagtacgcccaacaacatacaatctaa

SEQ ID NO: 47 - DNA, 3921 bp, Prevotella sp.
atggctaagaattttgaagattttaaaagactttatcctctttcaaagactttgcgctttgaagcgaagcctattggcgccactttggataatatagttaagagtggtttgttggaagaagatgaacacagagctgcaagctatgtgaaggtgaagaaattgattgatgaataccacaaggtatttattgatagagtgttggataatggatgtttgcctttggatgataaaggtgataataattcattggcagaatattatgagagctatgtatctaaagcgcaagatgaggatgcaataaagaagtttaaggaaattcagcaaaatcttctctctattatagctaaaaagctaacagacgataaggcttatgctaatttgtttggtaataaacttatagagtcatataaggacaaagctgataagacaaagctaattgattcagatttgattcaattcatcaatactgcggaatcaactcaacttgtttcaatgtcacaagatgaggccaaagaactcgtaaaagaattctggggctttactacatattttgaaggtttcttcaaaaatcgtaaaaatatgtatactccagaagaaaagtctactggtattgcttatcgtctaatcaatgaaaaccttccaaagttcattgataatatggaggctttcaagaaagctatcgctagaccagagatacaggctaacatggaagagttatactctaatttttctgaatacttaaatgtagaaagtattcaggagatgttcctgcttgactattacaatatgcttcttactcaaaagcagattgatgtctataatgctataattggaggaaaaaccgatgatgagcacgatgttaagattaaaggtatcaacgagtatatcaatctctataatcagcagcataaagatgacaagttaccaaaacttaaggcattgtttaagcagattcttagtgatagaaatgcaatatcttggttgccagaagagttcaatagtgatcaggaagtcttgaatgcaatcaaggattgctatgagcgattggctgaaaatgttttgggtgataaggttctcaagtctttgcttggttctttggcagattattctcttgatgggatatttatccgtaatgacttgcagttgactgatatttctcagaaaatgtttggaaattggggtgtgattcagaatgctatcatgcagaatataaagcatgttgctcctgcaagaaagcataaggagtctgaggaagattacgaaaaaagaattgctggtatattcaaaaaggcagatagttttagtatcagttatataaatgattgcttgaacgaagcagatcctaataatgcctactttgtagagaactatttcgcaacatttggagcggtaaatactccaacaatgcagcgtgagaatctgtttgcgcttgttcaaaatgcgtatacagaagttgctgcattacttcattctgattatcctacggtaaagcatctggcacaagacaaggctaatgtttctaaaatcaaagcactgttggatgcaataaagtctttgcagcatttcgtgaagcctctgttgggcaagggtgatgaaagtgataaagatgaacgtttctatggtgaactagcttcgttgtgggcagaacttgatacagtgacaccgctgtataatatgattcgtaattatatgactcgtaaaccatattctcaaaagaaaatcaaacttaactttgagaatcctcaattgcttggtggttgggatgctaataaggagaaagactatgctaccattatcttacgtcgtaatgggttgtattatcttgctattatggacaaagactcaaggaagttattgggtaaggcaatgccgtcagatggggagtgctatgagaaaatggtatataagttcttcaaagacgtgacaacgatgataccaaagtgtagtacacaattaaaagatgtacaagcttattttaaggttaatacagatgattacgtcttaaatagcaaggcgtttaacaggccattgacgataacaaaggaagtctttgatttgaacaatgtattgtatggtaagtataagaaattccaaaagggatacttgactgctactggtgataatgtaggttatactcatgctgtaaacgtatggataaaattctgtatggattttttggacagctatgatagcacttgcatatatgatttctcttctttgaaaccggagtcatatttgtcactcgactctttctatcaggatgttaatttgttgttgtataaattgtcgtttacagatgtatctgcatcatttattgatcagcttgttgaggagggaaagatgtatctgttccaaatctacaataaggatttctctgagtatagcaagggcactccaaatatgcatactctttattggaaagcattgtttgatgaacgtaatctggcagatgtagtttacaagcttaacggacaggcagagatgttctatcgtaagaaaagtatagaaaatactcatccaactcatcctgctaatcatcctattcttaataagaataaggataacaagaaaaaagaaagcttgtttgaatatgatcttataaaagatcgtcgctacactgttgataaatttatgttccatgtgccaatcacaatgaactttaaaagttctggttctgagaacatcaatcaagatgtgaaggcgtatttgcgtcacgcagatgatatgcatattattggtattgatcgtggcgaacgtcatttgctgtatttggttgtaattgatttgcaaggtaatatcaaggagcagttctcgcttaatgaaattgtgaatgattataatggtaatacctatcataccaattatcacgatttgttggatgttcgtgaagacgaacgactcaaagctcgtcaaagttggcagaccatcgaaaatatcaaagagctgaaagagggctatttgtctcaggttatccacaagattacacagctcatggttagatatcatgccattgttgttttggaagatctgagcaagggatttatgcgtagtcgtcaaaaggtagaaaagcaagtatatcagaagtttgaaaaaatgttgatagataagcttaactatttggtagacaaaaaaactgatgtttctactcctggaggcttgctgaatgcataccaacttacctgtaagtctgatagttctcaaaagttaggaaaacagagcggattcctgttctatatccctgcatggaatacatctaagatagacccagttacaggatttgtcaacttgttggatactcattctttaaattctaaagagaaaatcaaagcattcttctctaagtttgatgctatccgttataataaggataagaaatggtttgagtttaatctcgactatgacaagtttggtaaaaaagcggaagatacaaggactaagtggactttatgcaccagaggaatgcgtattgatactttcagaaataaagaaaagaactcgcagtgggataatcaggaagttgacttgacaacagagatgaaatctttattggagcattattatatcgacattcatggtaatctcaaggatgctatcagtacgcaaacagacaaagcgttctttactggcttgctgcacatattgaagttgaccttgcagatgcgtaatagtattactggaaccgaaacagattacttagtgtctcctgttgccgatgagaatggaatattctacgatagccgttcttgtggtgatcagcttcctgagaatgcggatgctaatggtgcttacaacatcgctcgcaagggactgatgttggttgagcagataaaagatgctgaggatttggataatgtgaagtttgatatatccaataaggcttggctcaattttgcacaacaaaagccatataagaatggatga

SEQ ID NO: 48 - DNA, 3921 bp, Artificial Sequence
  Description of Artificial Sequence: Synthetic polynucleotide
atggcaaagaactttgaagactttaaacgcttataccccttatcgaagacacttcgctttgaagcaaagccgatcggggccacgctggataatatcgtgaaatcggggctgttagaggaagacgaacaccgcgccgcctcctacgtcaaggtcaaaaaacttatcgatgagtaccataaggtctttattgatcgtgttttggacaacggttgtttaccgctggatgataaaggtgacaataattctcttgccgaatactacgaatcgtatgtatcaaaagcccaagacgaggatgcaattaagaaattcaaagaaattcagcaaaatttgctgagtattatcgcaaagaaacttacagacgataaagcctatgccaacttattcggaaataaacttatcgaaagttacaaagacaaagcggacaaaacgaagcttattgatagcgacttgattcagtttattaatacggctgagtctacccaattagtttccatgtcacaagacgaagctaaggagttggtaaaagaattttggggctttactacctatttcgaaggcttcttcaagaaccgtaagaatatgtataccccagaagaaaagagtacagggatcgcttaccgcttaatcaacgaaaacttaccaaaattcattgacaacatggaggcgttcaaaaaagcgatcgcccgtcccgagatccaagcaaacatggaagaactttactctaacttctctgagtacctgaacgtagagtctattcaagagatgttcctgcttgactactacaacatgctgttaactcaaaagcagattgatgtgtacaatgccatcattgggggcaagacagacgacgaacatgacgtcaagatcaaggggattaatgaatatatcaacttgtataaccagcagcataaagatgacaaattaccaaagctgaaagctcttttcaaacagatcctgtctgaccgtaatgccatctcctggttgcctgaggagttcaattctgaccaggaggtgcttaacgcgattaaagactgttacgagcgtctggcggaaaacgttttgggtgataaggtccttaaaagccttctgggctcattagcagattattcgttggatgggatcttcatccgtaatgaccttcagcttacggatatttcgcagaagatgtttgggaattggggggttattcagaacgcaattatgcaaaacatcaaacacgttgctccggcacgcaagcataaggagtcagaggaggactatgaaaagcgtatcgcaggaatttttaaaaaagctgactcgttttccatctcatatatcaacgactgtcttaatgaagctgacccgaataatgcatattttgttgaaaactactttgccactttcggtgccgtaaatacgccaacaatgcagcgtgaaaatttgtttgcacttgtccaaaatgcgtataccgaagtcgcagcacttctgcattctgattatccgactgttaaacatctggctcaggacaaagctaacgtctcgaagatcaaggcattattggacgcaattaaatccttacagcacttcgtcaagccgttgctggggaagggggatgagtcagacaaggatgaacgcttttacggtgaacttgcctccttgtgggccgagctggataccgtcacccctctgtataatatgattcgtaactacatgacgcgtaagccctacagtcagaagaagattaagttgaactttgagaatccgcaattattgggaggctgggatgccaacaaggagaaggattatgctaccatcattctgcgtcgtaacgggctttactacttagcgatcatggacaaggacagccgtaaattattaggtaaggccatgccttctgacggcgaatgctacgaaaaaatggtctacaaattttttaaggatgttactaccatgattccgaagtgttccacgcaacttaaagacgtgcaggcctactttaaggttaacaccgatgactacgtcctgaattctaaggcttttaaccgtccgctgacaattactaaagaagttttcgacttaaataatgtcttgtatggcaaatacaagaaattccaaaagggatatttgactgcgactggcgataatgtaggctatacgcacgcagtcaatgtatggattaaattttgcatggatttcttggactcatacgacagtacgtgcatctatgatttctcgagccttaagcccgagtcgtatttgtcgttggatagtttttatcaggacgttaacctgttattatacaagctgagctttactgacgtgtcggcctcgtttatcgatcaattagtggaagaagggaaaatgtacctgtttcaaatttataacaaagacttttcagagtattcaaaggggactccaaatatgcacacgctgtattggaaggctttatttgatgagcgcaacttggcagacgtcgtttataagcttaacggacaagctgagatgttttatcgcaagaagtcgatcgaaaatacccacccgacacatcccgcaaatcatcccatcttgaataaaaacaaagataataagaagaaggaaagtctttttgagtatgatttaattaaagaccgccgttacacagttgataagttcatgttccacgtaccgatcacgatgaattttaaaagtagcggatccgagaacattaaccaagacgttaaagcttaccttcgccacgccgatgacatgcatatcattgggatcgaccgtggagaacgtcatctgttatacttggtcgtaatcgacctgcaagggaatattaaggagcaattttcattaaacgagattgtgaacgattataacggtaacacgtaccatacgaactaccacgatctgttggatgtccgtgaggatgaacgtctgaaggctcgtcagtcatggcaaactatcgaaaacattaaagagttaaaagagggttatttgtcccaagtaatccataagattacgcagttgatggtgcgttatcatgccattgtggttttggaggacctgtcaaaagggttcatgcgctcgcgccaaaaggtagaaaaacaggtttatcaaaagtttgagaaaatgctgatcgacaaacttaattacctggtagataaaaagacggatgtgagcactccggggggtctgttaaatgcttatcagctgacttgtaaatcagattccagccagaaattgggcaaacagagtggatttcttttttatatccccgcgtggaatacctctaagattgacccggtaacgggtttcgtaaacttgcttgatacacattcgctgaacagtaaggagaagatcaaagctttcttctccaaatttgatgcgattcgctacaacaaagataagaagtggtttgagtttaaccttgactacgataagtttggcaaaaaagcggaagatacgcgcaccaagtggacattgtgcactcgtgggatgcgcatcgacactttccgcaacaaagaaaagaatagccaatgggataaccaagaggtggatcttactaccgaaatgaaatcgttactggagcactattacatcgacatccatggaaacctgaaggacgcgatcagcacacaaacagacaaagccttctttactggcttgcttcacatcttgaagcttacgttgcagatgcgcaactctattacgggtacggaaactgattatttagtatctcctgttgctgacgaaaacggcattttctatgattcgcgttcttgcggagatcaattaccagagaatgcggatgctaacggcgcctacaacattgcccgtaaaggtttaatgttagtggaacaaattaaagacgccgaagaccttgacaacgtcaagtttgatattagtaacaaggcgtggcttaattttgcacagcaaaaaccatataagaatggctga

SEQ ID NO: 49 - DNA, 3921 bp, Artificial Sequence
  Description of Artificial Sequence: Synthetic polynucleotide
atggcgaagaattttgaagacttcaagcgtctttacccattatctaaaacattacgtttcgaagctaaaccaatcggagcgacccttgataacattgtcaagtccgggcttctggaggaggatgagcaccgcgctgcctcgtatgttaaggttaagaagctgattgatgagtatcataaggtattcatcgaccgtgtccttgataacggatgcttgcctctggacgataaaggtgacaacaactcccttgctgagtactacgagagctacgtgtccaaggcgcaagatgaagacgccattaaaaaattcaaggagatccagcaaaaccttctgtcgattatcgccaaaaagcttacagatgataaagcttacgccaacttgtttggcaacaaactgattgagagctataaagataaagcggacaagacgaaattaatcgacagcgaccttatccagtttattaacacagccgagtcgacccaattggtcagcatgtcccaggacgaggccaaggagttggtaaaggaattttggggattcacaacttactttgagggttttttcaagaaccgtaaaaatatgtatacacctgaagagaaatctactggtattgcgtaccgcctgatcaatgagaacttaccaaaatttatcgacaacatggaggcctttaagaaggccattgcccgtccagagatccaggcgaatatggaagaactgtattccaattttagtgaatatctgaacgtggagtccatccaagagatgtttttattggactactacaacatgctgcttacccagaaacaaatcgatgtctataacgcgatcattggaggtaaaacggacgatgagcacgatgtaaagattaaagggatcaatgaatacatcaacctgtacaaccaacaacataaagacgataaattgcctaagttaaaggccttgtttaagcagattttatctgatcgtaatgccatcagttggctgcccgaagagtttaattcggatcaggaggtattgaacgctattaaagattgctatgaacgcctggctgagaacgtccttggggataaagtgttaaaatcactgcttgggtcactggcagattattcccttgatggtattttcatccgcaacgatttgcagcttacagacatctcacaaaaaatgttcggtaattggggtgtaatccaaaacgcgattatgcagaatattaaacatgtcgcaccggctcgtaagcacaaggaaagtgaagaagactacgagaagcgtattgccggtatctttaaaaaagccgattcgttttcgatttcgtacatcaatgactgccttaacgaagctgaccccaacaacgcctactttgtggaaaattattttgctactttcggtgccgtaaatacacctacaatgcaacgcgagaacttatttgcacttgtgcagaatgcatacacagaggtcgctgcactgttgcattctgactacccgacagttaagcaccttgcccaagacaaggccaacgtatcgaaaattaaggcgctgctggatgctatcaagtcactgcaacattttgtgaaaccgttacttggcaaaggagacgagtcagataaggacgaacgcttctacggagaacttgcttcgttgtgggccgaattagacacggtcacccccttatacaacatgatccgtaactacatgacacgcaagccgtatagccagaaaaagattaaacttaactttgagaatcctcaactgctggggggatgggatgcgaataaagagaaggattatgccacaattatcctgcgtcgtaatggcctttattacttagctattatggataaggactcacgcaaattattgggtaaagccatgccctctgatggtgagtgctacgagaaaatggtctacaaattcttcaaagacgtaactactatgatcccgaaatgcagtactcagttaaaggacgtacaggcttattttaaagtaaacaccgatgattacgtcctgaattccaaggcgtttaatcgtccacttaccattacaaaagaagtattcgatttgaacaacgtattgtacggaaagtacaagaagttccagaaggggtatctgaccgctacaggtgataatgtaggttatacacacgccgtgaacgtgtggatcaagttttgtatggattttctggattcatacgactccacttgcatttatgattttagctctcttaagccagaatcatatctttccttagacagtttctatcaggatgttaatcttcttttatacaaattgtcctttacggacgtttcagcgtcctttattgaccagcttgtagaggagggcaagatgtacctttttcagatctataacaaagacttttcggagtactctaaggggacacccaacatgcatacgttgtattggaaagccctgttcgatgaacgtaatcttgcggacgtcgtatacaagcttaacggtcaagcggaaatgttttatcgtaagaagtccattgagaatacccatccaacccacccggcaaatcatccaatccttaataaaaacaaggataataaaaaaaaggagtcgctgtttgagtatgacttaattaaggaccgccgctacacggtggacaagttcatgttccacgtcccaattacaatgaatttcaagtcaagtggttctgaaaatatcaatcaagacgtaaaagcataccttcgtcatgccgacgacatgcacatcatcggcattgaccgtggtgaacgccacttgctttatctggtcgtcatcgacttgcaaggcaacatcaaagagcaattctcacttaatgagattgtaaatgattacaatggaaacacatatcacactaattaccacgatcttctggatgtccgcgaagacgaacgtttgaaggcacgtcaatcctggcaaaccattgaaaatattaaggaactgaaggagggttatttatctcaagtaatccacaaaattacccaactgatggttcgttatcacgcgattgtagtcttggaggacctgtccaagggatttatgcgtagtcgccaaaaagtggagaagcaagtttatcaaaagttcgaaaaaatgttaattgacaaacttaactaccttgtcgataagaagaccgacgtgtccacccctggcgggttactgaacgcgtaccagctgacatgtaagtcagactcctctcagaaacttggcaagcagtcaggatttttgttttatatccctgcttggaacaccagcaagatcgatccggttaccggttttgtaaaccttctggatactcatagtcttaactcgaaggagaaaatcaaggcttttttctccaagttcgatgccattcgttataacaaagataaaaagtggtttgagttcaatttggactacgataagtttggaaaaaaagccgaagacacgcgcaccaagtggacgctttgtacgcgtggaatgcgcattgacacatttcgtaataaggaaaaaaactcacaatgggacaatcaagaagtagatttaacgacagaaatgaaaagtcttttggagcattactatattgatattcatgggaatcttaaggatgctatttccactcaaaccgataaagccttttttacggggcttttacacattttaaaacttaccttacaaatgcgcaactcgatcacggggaccgaaactgattatttggtgtctcctgttgccgacgaaaacggaatcttctatgactctcgctcttgtggggatcaattaccggaaaatgctgacgcaaatggcgcgtacaatattgctcgcaaggggttgatgttggtagagcagatcaaggacgctgaggatttggataatgtgaagtttgacatctctaataaagcgtggcttaatttcgcacagcagaaaccatacaaaaacggatga

SEQ ID NO: 50 - DNA, 3921 bp, Artificial Sequence
  Description of Artificial Sequence: Synthetic polynucleotide
atggcgaagaacttcgaggacttcaagcgcttatatcctctgtccaaaacgcttcgttttgaagctaaaccgatcggtgcgaccttggataacattgtgaaatctgggctgttggaggaagatgagcaccgcgcagcctcgtacgtaaaagttaagaagcttattgatgagtaccacaaagtctttattgaccgtgtgttagataacggctgcttgcccttagatgacaaaggggataataactcgttagcagagtactatgaatcgtatgtaagtaaagcacaggacgaggatgcaattaagaaattcaaggaaatccaacagaatttattatccattattgctaaaaagttaaccgatgacaaagcttacgcgaacttgtttggcaacaagcttattgagagttataaggacaaggctgacaaaacgaagctgatcgactccgaccttatccagtttatcaatacagccgagtcaactcagttggtgtcaatgtcacaagatgaagcaaaggaacttgtgaaagagttctggggatttacaacttattttgagggattctttaaaaatcgtaagaacatgtacacgcccgaagaaaagtcgacgggaattgcgtatcgcctgattaatgaaaacctgccgaagttcattgacaatatggaggccttcaagaaggctatcgcacgccccgagatccaagctaacatggaagaactgtattcgaatttttcagagtacttgaacgttgaaagcatccaagagatgttcttgcttgattattacaatatgttgttaactcaaaaacagattgatgtgtacaacgcaatcattggtggcaaaaccgatgatgaacacgacgtgaaaatcaaagggattaatgagtacattaacttatataaccagcaacataaggacgataaattaccgaaattgaaagctctgtttaagcagatccttagtgatcgcaacgctatctcgtggctgccagaagagttcaacagcgatcaagaagttttaaatgcaatcaaagactgttacgaacgtttggctgaaaacgttttaggagacaaagttttaaagtcccttcttgggagcttggctgactactcattagacggtatttttatccgcaacgatcttcaattgacggacatctcacagaaaatgtttggtaattggggagtaatccaaaacgcaattatgcaaaatattaagcatgtggcgcctgcacgtaagcataaggagtcggaagaagattacgaaaagcgcattgcggggatcttcaagaaagctgactctttttcgatttcttatattaatgattgcttgaatgaggccgatcctaataacgcctactttgtagagaactattttgcgacttttggagcagtgaatacaccgaccatgcaacgtgaaaacttgtttgctctggtccaaaatgcctatactgaagtagccgcacttctgcattccgattatcctaccgtaaaacacctggcacaggataaagccaatgtgagtaagatcaaggctcttttggatgccattaagtctctgcagcattttgtaaaaccactgctgggaaaaggagatgagtcagataaagacgaacgcttttacggagaattagcgtcgctgtgggcagaactggacacagttactcctctgtataatatgatccgtaattatatgactcgcaaaccttattcacaaaagaagattaagctgaatttcgagaaccctcaattgttaggaggatgggacgctaacaaggaaaaagattatgctaccattatccttcgtcgcaatggattatattatcttgctattatggacaaagactcgcgcaaattgttagggaaagccatgccctccgatggcgaatgctacgaaaagatggtgtataaattctttaaggatgttacgaccatgattcccaaatgtagcacacaattaaaagacgtacaagcatacttcaaggttaacactgacgattatgttcttaactcgaaagcgttcaaccgccccctgaccatcaccaaagaagtatttgatttgaataacgttttgtatgggaagtacaagaaattccagaaaggatacttaactgctacgggtgacaatgttgggtatacgcatgcagtaaacgtttggattaagttctgtatggacttcttagactcctatgattcgacatgtatctatgacttcagcagcctgaagccagaatcatatctgtctctggattctttctatcaagacgtaaatcttctgctgtacaagttgtccttcactgacgtctcggcgagcttcattgatcagttggtggaggaaggcaagatgtacctttttcagatttacaacaaagacttcagtgagtatagcaaagggacccccaatatgcatacactttattggaaagcactgttcgacgagcgtaatctggccgacgttgtctacaagttaaacggtcaggctgaaatgttttatcgcaagaaaagtattgaaaatacacatcccacccatccggcgaaccatccaattcttaataaaaacaaggataacaaaaaaaaggagtcgctgtttgaatacgacctgattaaagatcgtcgttataccgtcgacaaatttatgtttcacgttcctattactatgaattttaaatcaagcggtagcgaaaacatcaatcaggatgtcaaagcgtatcttcgccacgcggatgacatgcacatcatcggtatcgaccgtggggagcgtcaccttctttacttagtcgtcatcgatctgcaaggcaacatcaaagagcaatttagcttgaatgagattgttaatgattataatggtaacacttatcatactaattatcatgacttgttagatgtgcgcgaggatgagcgtttaaaagcgcgccaatcttggcaaaccatcgagaacatcaaagaattgaaggaaggttacttatctcaagttattcacaagattacacagttaatggtacgttaccatgcgattgtggttttagaggacttatctaaagggtttatgcgttcgcgccaaaaagtggagaagcaagtctaccaaaagttcgagaagatgttgatcgataaattgaattatcttgttgataaaaagactgatgtgagtacgcctggtgggttattgaatgcctaccagttaacttgcaagagcgactcttcgcaaaagcttgggaaacagagcgggttccttttctatattccagcatggaacacttcaaagattgaccctgtaacgggctttgtaaacttgttagatacacatagtctgaatagtaaagagaagattaaagcattcttctcaaagttcgatgcaattcgctacaacaaggacaagaaatggttcgaatttaacttggattatgacaagtttgggaagaaagcagaggacactcgtacgaagtggactctttgcacacgtgggatgcgcatcgacacttttcgcaacaaggaaaaaaactcgcagtgggataatcaggaagtggacctgactaccgaaatgaaaagcttattagaacattactacattgatattcacggtaatctgaaagatgcaatctcaacccaaaccgacaaagccttcttcacagggttgcttcatatcttgaaacttacccttcaaatgcgtaactcgatcacagggactgagacggactatttagtctcacccgtggcagatgagaatgggatcttttacgattcgcgctcctgtggagatcaacttcccgagaacgctgacgcgaacggcgcttataatattgcacgtaaaggactgatgttggtggaacagatcaaggatgctgaggatttggataatgtcaaatttgacatcagtaacaaagcgtggttaaactttgcccagcaaaaaccctataagaacggttga

SEQ ID NO: 51 - DNA, 3921 bp, Prevotella copri
atggctaagaattttgaagattttaagagactttattctctttcaaagactttgcgctttgaagcgaagcctattggtgccactttggataatatagtcaaaagtggtttgctggatgaagatgaacacagagctgcaagctatgtgaaggtgaagaaattgattgatgaatatcacaaggtatttattgatagagtgttggatgatggctgtttgcctttggaaaataaaggtaataataattcattggcagaatattatgagagctatgtatctagagcgcaagatgaggatgcaaaaaagaagtttaaggaaatacagcaaaatcttcgttctgtcattgcgaaaaaactaaccgaagataaggcttatgctaatttgtttggtaacaaacttatagagtcgtataaggacaaagaggataagaaaaagataattgattcagatttgattcaattcatcaataccgcagaatcaactcaacttgattctatgtcacaagatgaggccaaagaacttgtgaaagaattctggggctttgttacttatttttacggcttctttgataatcgtaaaaatatgtatacggcagaagagaagtcaactggtattgcttatcgactagttaatgaaaaccttccaaaattcattgataatatagaggcttttaatagagctataaccagaccagagatacaggaaaatatgggagtcttgtattcagatttttccgaatacttaaatgtagaaagtattcaggagatgttccagcttgactattataatatgctccttactcaaaagcagattgatgtctataatgctataattggaggaaaaaccgatgatgagcacgatgttaagattaaaggtatcaatgagtatatcaatctctacaatcagcagcataaagatgacaagttaccaaaacttaaggctttgtttaagcagattcttagtgatagaaatgcaatatcttggttgccagaagagttcaatagtgatcaggaagtcttgaatgcaatcaaggattgctatgagcgattggctgaaaatgttttgggtgataaggttctcaagtctttgcttggttctttggcagattattctcttgatgggatatttatccgtaatgacttacagttgactgatatttctcagaaaatgtttggaaattggggcgtgattcagaatgctatcatgcagaatataaagcgtgtcgctcctgccagaaagcataaggagtctgaggaagattacgaaaaaagaattgctggtatattcaaaaaggcagatagctttagtatcagttatataaatgattgtttgaacgaagcagatcctaataatgcctactttgtagagaactattttgcaacatttggagcggtaaatactccaacaatgcagcgtgagaatctgtttgcgcttgttcaaaatgcgtatacagaagttgctgcattacttcattctgattatcctacagtaaagcatctggcacaagacaaggctaatgtttctaaaatcaaagcactgttggatgcaataaagtctttgcagcatttcgtgaagcctctgttgggcaagggtgatgaaagtgataaagatgaacgtttctatggtgaactagcttcgttgtgggcagaacttgatacagtgacaccgctgtataatatgattcgtaattatatgactcgtaaaccatattctcaaaagaagatcaaacttaactttgagaatcctcaattgcttggtggttgggatgctaataaggagaaagactatgctaccattatcttacgtcgtaatgggttgtattatcttgctattatggacaaagactcaaggaagttattgggtaaggcaatgccgtcagatggggagtgctatgagaaaatggtatataagttcttcaaagacgtgacaacgatgataccaaagtgtagtacacaattaaaagatgtacaagcttattttaaggttaatacagatgattacgtcttaaatagcaaggcgtttaacaagccattgacgataacaaaggaagtctttgatttgaacaatgtattgtatggtaagtataagaaattccaaaagggatacttgactgctactggtgataatgtaggttatacccatgctgtaaacgtatggataaaattctgtatggattttttgaacagctatgatagcacttgcatatatgatttctcttctttgaaaccagagtcatatttgtcgcttgatgcattctatcaagatgctaatttgttgttgtataaattgtcttttgcaagagcatctgtatcgtatatcaaccagcttgttgaggaggggaagatgtatctgttccaaatctacaataaggatttctctgagtatagcaaaggcactccaaatatgcatactctttattggaaagcattgtttgatgaacgtaatctggcagatgtagtttacaagcttaacggacaggcagagatgttctatcgtaagaaaagtatagaaaatactcatccaactcatcctgctaatcatcctattcttaacaagaataaggataacaagaaaaaagaaagcttgtttgactatgatcttataaaagatcgtcgctacactgttgataaatttatgttccatgtgccaatcacaatgaatttcaagagcgttggctcagagaatatcaatcaagatgtgaaggcgtatttgcgtcatgcagatgatatgcatattattggtattgatcgtggtgaacgtcatttgctttatctggttgttatagatttgcagggaaatatcaaggaacagtactcgcttaatgaaatagtgaatgagtataatggtaatacctatcataccaattatcacgatttgttggatgttcgtgaagaagaacgacttaaagctcgtcaaagttggcagaccatcgaaaatattaaagagctgaaagagggctatttgtctcaggttatccacaagattacacagctcatggttagatatcatgccattgttgttttggaagatctgagcaagggatttatgcgtagtcgtcaaaaggtagaaaagcaagtatatcagaagtttgaaaaaatgttgatagataagcttaactatttggtagacaaaaaaactgatgtttctactcctggaggcttgctgaatgcataccaacttacctgtaagtctgatagttctcaaaagttaggaaaacagagcggattcctgttctatatccctgcatggaatacatctaagatagacccagttacaggatttgtcaacttgttggatactcattctttaaattctaaagagaaaatcaaagctttcttctctaagtttgatgctatccgttataataaggataagaaatggtttgagtttaatctcgactatgacaagtttggtaaaaaagcggaagatacaaggactaagtggactttatgcaccagaggaatgcgtattgatactttcagaaataaagaaaagaactcgcagtgggataatcaggaagttgacttgacaacagagatgaaatctttattggagcattattatatcgacattcatggtaatctcaaggatgctatcagtgcgcaaacagacaaggccttctttacgggattgctacacattttgaagttgactttgcagatgcgtaatagtatcactggaacagaaactgattatctggtatctcctgttgccgatgagaatggaatattctacgatagccgttcttgtggtaatcaacttcctgagaatgcggatgctaatggtgcttataacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 52 - DNA, 3921 bp, Artificial Sequence
  Description of Artificial Sequence: Synthetic polynucleotide
atggcgaagaatttcgaggacttcaaacgcctgtattctttgtctaagacacttcgttttgaggcaaagccgatcggagcgaccctggataacatcgtaaagtctggcttacttgatgaagatgagcatcgcgcggcgagctatgttaaggtaaaaaagttaatcgacgagtaccataaagttttcattgatcgtgttttagatgacggatgccttcctcttgaaaacaaaggtaataataacagcttggcggaatattatgagtcttatgtctctcgtgcgcaagatgaagatgcgaagaagaaatttaaggagatccaacaaaatcttcgcagcgtaattgctaaaaaactgactgaggataaggcctacgcgaacctgtttggcaacaagctgattgaatcttataaggataaagaagacaagaagaaaatcattgactcagatttaatccagtttatcaataccgctgagagtacgcaattagactctatgagccaagacgaggccaaagaacttgttaaggagttctgggggttcgtcacttatttctatggtttcttcgacaatcgtaaaaatatgtacactgctgaagagaagagtacggggatcgcttaccgcctggtaaatgaaaatttgcccaagtttattgacaacatcgaagcttttaatcgtgcgatcacacgtccggagatccaggagaacatgggggtgctttattccgacttcagtgaatatttgaatgtggaatcgattcaagaaatgttccagcttgattactataatatgttgttaactcagaagcaaatcgatgtgtataacgcaatcatcggtggaaagactgacgacgaacacgatgtaaagatcaaagggattaatgaatatattaacttatataatcaacaacataaagacgataaattgccaaagttgaaggcgttgtttaaacaaattctttccgaccgcaacgcgatctcgtggctgcccgaagagttcaactctgaccaagaggttttaaatgccattaaagactgttatgagcgccttgctgagaacgtcttaggcgacaaggtattgaagagcctgcttggttccctggctgattattcattagatggaatttttattcgtaacgatttgcagcttaccgatatctctcagaagatgttcggcaattggggggtcattcaaaatgcgatcatgcaaaacattaaacgcgtcgccccggctcgtaaacataaggaaagcgaggaggactatgagaaacgtattgccggaatcttcaagaaagctgactcgttcagtatctcctacatcaacgattgtttgaatgaagctgaccccaataatgcatactttgtagagaattacttcgcgacattcggggctgtaaacacacccacaatgcagcgcgagaatttgttcgcgttggtacagaatgcgtacaccgaagtcgctgcattattgcacagcgactaccccacggttaagcacttggcgcaagacaaagccaacgtctccaagatcaaggcgcttcttgacgctattaagtctttacagcattttgttaagccgttactgggcaaaggtgatgagtcggacaaggatgaacgtttctacggcgagttagcttcattatgggcggaactggacaccgttactcccttatataatatgatccgcaattacatgacgcgcaagccgtactcacaaaagaagattaagttaaactttgaaaatcctcaacttcttggaggttgggacgctaacaaagagaaggactacgccacgatcatcctgcgtcgtaacgggttatactatcttgcaatcatggataaagatagtcgcaagttgcttgggaaggctatgccatcggacggcgaatgttacgagaaaatggtgtataaattctttaaggacgtgacaacaatgatcccgaagtgctcgacccagcttaaagacgtccaagcttactttaaggtcaacacagatgactatgttctgaacagcaaggcttttaacaagccactgacaatcaccaaagaggtattcgatctgaataatgtcttatacggcaagtacaaaaaattccaaaagggatacttgacggcgactggtgacaacgtagggtacacccacgccgttaatgtgtggatcaagttttgtatggactttttgaacagctacgactctacctgcatttacgactttagtagcctgaaacccgagagttacttgtcattagatgcgttctaccaggacgccaatctgttgttgtacaaattgagctttgcgcgcgcttcagtctcctacatcaaccaattggttgaggagggcaagatgtacttgttccaaatttataacaaggacttttctgagtattccaaaggaacacctaacatgcacactttgtattggaaagcactgttcgatgaacgtaatttggcggatgttgtgtacaaattaaacggccaagctgagatgttctatcgtaagaaatctattgaaaacacccatccaacacatccggcgaaccatccgattttaaataaaaacaaggacaataaaaaaaaagagagtttatttgactatgatttgatcaaggatcgccgttacacagttgacaagtttatgttccatgtcccaatcacaatgaacttcaagtccgtggggtccgaaaatattaatcaagatgtaaaggcgtacttgcgccacgcagacgatatgcacattattggaatcgatcgtggagagcgccacttgctgtacttagtcgtaatcgatctgcagggcaatattaaagaacagtacagtcttaacgagatcgtgaacgagtacaacggaaatacgtatcacaccaactaccatgacctgttagatgtacgcgaagaagagcgcttgaaagcccgccagtcctggcaaaccattgagaatattaaggaacttaaagaggggtatctttcgcaggtgattcacaaaatcacgcagttaatggttcgttatcatgccatcgtggttctggaagatcttagcaaagggttcatgcgcagccgccagaaagtggaaaagcaggtctaccaaaaattcgagaagatgttaatcgacaaattaaattacttggttgacaaaaaaacagatgtatcaacacctggcgggctgcttaatgcatatcagcttacttgtaagagtgattcgtcccaaaaactgggaaagcagtctgggtttctgttttacattccagcttggaacaccagtaagattgacccagtaacaggcttcgtgaacttactggacacccatagtttgaactcgaaggagaaaattaaggcatttttctcgaaattcgatgctattcgttataataaagacaaaaagtggttcgagttcaatctggactatgataagtttgggaagaaagctgaggacactcgcactaaatggacgttatgtacgcgtggcatgcgcatcgatacgtttcgcaacaaggagaaaaattctcagtgggacaatcaggaagtggacttgaccacggaaatgaagagtctgttagagcattattatattgacattcatggaaaccttaaggatgctatctcagctcaaacagacaaggcatttttcacgggccttctgcacatcttgaagctgacgcttcaaatgcgcaattcgattacgggaactgaaaccgactatttggtgagtccggtcgccgacgaaaacggaattttttacgatagtcgttcttgtggaaatcagctgccggagaatgcagacgcgaatggggcctataatatcgcacgtaaaggactgatgttgatcgagcaaattaagaacgcggaggacttgaacaatgtaaaattcgacatctcgaacaaggcctggctgaactttgcacagcaaaaaccatataagaatggctga

SEQ ID NO: 53 - DNA, 3921 bp, Artificial Sequence
  Description of Artificial Sequence: Synthetic polynucleotide
atggcgaagaatttcgaagacttcaagcgtctttactcactgtcaaaaactcttcgtttcgaagctaaaccgatcggcgccaccttggacaatatcgtaaagtccggccttttagatgaggacgaacatcgtgcagctagctatgtcaaagtaaaaaagctgatcgacgaataccacaaggtgttcattgaccgtgtgcttgatgatggttgtctgccactggagaataaaggtaataataactcgttagccgagtattatgagagctatgtgagccgtgcccaagatgaagacgctaaaaagaagttcaaagagatccaacagaacctgcgcagtgtaatcgcaaagaaacttacagaagataaagcctacgcgaatttatttggaaataagcttatcgaatcctataaagataaggaagacaagaaaaagattatcgatagcgaccttatccagttcatcaacacagccgaaagcacccagttagactctatgtcgcaagacgaggcgaaagaactggtcaaagaattctggggattcgttacgtatttctacggttttttcgataaccgcaaaaatatgtatacggctgaggagaaaagtacgggtatcgcctaccgcctggtgaatgagaatttgcctaagttcatcgataatattgaagcgttcaaccgtgcgattacgcgtccggaaattcaagaaaacatgggcgtcctgtatagcgacttcagcgaatatcttaacgtagaatcaatccaagagatgtttcaacttgattattataatatgctgttaacacagaaacagatcgacgtttacaatgctattattggaggtaaaacggacgacgaacacgacgttaaaattaagggcattaatgagtacattaacttatacaaccagcaacataaagatgataagctgccaaaactgaaagcattgttcaaacagattttgtctgaccgtaatgcaatcagttggcttccagaggagttcaattccgatcaagaggttcttaacgctattaaggattgttatgagcgcctggcagaaaacgtacttggggataaagtcttgaagagtcttttaggctcgctggccgactattcccttgacggtattttcattcgcaacgacttgcagttgactgatatttctcagaaaatgttcggaaattggggggtcattcaaaacgcgatcatgcaaaatattaagcgcgtcgccccggcacgcaagcacaaagagagcgaagaagactacgagaaacgcattgccgggatctttaagaaggccgactcattttctatttcttatattaatgattgtcttaatgaggcggatccaaacaatgcgtacttcgttgagaactattttgctacatttggcgctgtcaacacccctacgatgcagcgcgagaatctgtttgctttagtacaaaacgcatataccgaggttgcagcccttttgcattccgactatcctacggtgaaacatttagcacaagacaaagctaatgtctctaagatcaaggcgttgttggacgcgattaagtccctgcaacactttgtaaaaccattgctgggtaagggtgacgaatcagataaagacgagcgcttttacggggagctggcttcgttatgggcagaactggataccgtgactcccttatataacatgatccgcaactacatgacacgtaaaccatattcacagaaaaagattaagctgaactttgagaacccacagctgttgggcgggtgggacgcgaataaggaaaaagattatgccacaatcatcttacgccgtaacgggttgtactaccttgcaatcatggataaggactcacgcaaattattaggcaaggcgatgcctagtgacggcgaatgttacgaaaagatggtttataaattttttaaggatgttacaaccatgatcccaaagtgctccacgcagttaaaagacgttcaggcgtactttaaggtaaacacggatgactatgtactgaattcaaaggctttcaacaagcccctgaccatcacaaaagaggtttttgatcttaacaacgtgctttacggtaaatacaaaaaattccagaagggttacttgacggccactggtgacaacgttggttatacccatgccgtcaacgtatggatcaagttttgtatggacttcttaaattcttacgactcgacatgcatttatgatttttccagtctgaagccggagagttaccttagcctggatgccttttaccaggacgccaatttattgctttataagctgtctttcgcgcgcgcaagcgtgtcgtacattaaccaacttgtggaggaggggaagatgtacttgtttcagatctataataaggatttttctgagtattcgaagggtacccctaatatgcatacactttactggaaagctctttttgacgagcgtaaccttgccgacgtcgtgtacaagctgaacgggcaggcggaaatgttttatcgtaagaaatcgatcgaaaatactcaccctactcacccagccaaccatccgatcttgaataaaaataaggacaacaagaagaaggagagtctgtttgattacgacctgattaaagatcgccgttacaccgtagataaatttatgttccatgtaccgattactatgaacttcaagagcgtaggaagtgaaaatattaaccaggacgtaaaagcatacttgcgccatgccgatgatatgcacatcatcggtatcgaccgtggagagcgccatttactttatttggtagtgatcgatttgcaaggcaacatcaaagaacagtactcgttaaacgagatcgtgaacgaatacaacggaaacacgtaccatactaattaccacgacctgttagatgtccgcgaagaggagcgccttaaggcgcgccagtcgtggcaaactatcgagaatattaaagagttaaaggaagggtatctttcacaagtcatccataagattactcaattaatggtccgctaccatgccattgtagtcttggaggacctgagcaaggggtttatgcgctcacgtcagaaggttgaaaaacaagtctaccagaaatttgaaaaaatgctgattgataaactgaattacctggttgataaaaagacggatgtcagtacccctggcggtcttctgaatgcctatcaattaacatgcaagtcagactcttcgcagaagctggggaaacaatcagggtttttattttacattccagcgtggaacacaagcaagattgatcctgtcaccggttttgtcaaccttttggacacacatagtctgaactcgaaagaaaaaatcaaggcatttttcagtaagttcgatgcaatccgttacaacaaagataagaagtggttcgagttcaatcttgattacgacaagtttggcaagaaggctgaggatacgcgtacgaagtggacgctgtgtacccgtgggatgcgcattgacacattccgtaataaagagaaaaatagccaatgggacaaccaggaggtggaccttaccaccgagatgaagtccctgttggaacattactacatcgacatccatggtaaccttaaagacgcgattagcgcgcaaaccgataaggcctttttcacaggcctgctgcatatcttgaagttaactttgcaaatgcgcaattccattacagggacggaaactgattaccttgttagccccgtcgctgatgaaaatggcatcttctacgactcgcgtagttgcggaaatcagttaccggagaacgcggatgcaaacggggcatataatattgcccgtaagggacttatgttgatcgagcaaatcaaaaacgcagaggatcttaataacgttaaatttgatatttccaataaggcatggcttaacttcgcacagcagaagccgtacaaaaacggttga

SEQ ID NO: 54 - DNA, 3921 bp, Artificial Sequence
  Description of Artificial Sequence: Synthetic polynucleotide
atggctaagaattttgaagatttcaagcgcctttactcgctgtcgaaaacgcttcgtttcgaagcaaaaccaatcggggctacgttggataacatcgttaagagtggcttgttggatgaggacgaacaccgtgccgcgtcgtacgttaaagtgaaaaagttgattgacgagtaccataaagtgtttatcgaccgtgtattggacgacggctgccttccactggagaataagggtaacaataattccctggcagaatattatgagagttacgtttctcgcgcgcaagacgaagatgctaaaaaaaagtttaaagagattcagcaaaatttacgctcggtcatcgctaaaaaattaacggaagacaaggcttacgcaaatttattcggaaacaagttaattgagtcgtacaaggacaaagaggacaagaaaaaaattattgattccgatttaatccagttcatcaatacggctgagagtacacaacttgattcaatgtcccaagacgaagcgaaggaactggtcaaagaattctggggttttgttacgtatttttacggatttttcgataatcgtaagaacatgtacaccgcagaggagaagtcaactggaattgcatatcgtttagtgaacgagaacctgccgaaatttattgacaatatcgaagcttttaaccgcgctattacacgtcctgagattcaggagaacatgggggttttgtactctgatttctccgaataccttaacgtcgaaagtatccaggagatgtttcagctggactactataatatgcttcttacgcagaaacagatcgacgtgtataatgcgattattggcggcaaaacagacgatgaacacgacgtaaaaatcaagggtatcaacgagtatatcaatctttataatcaacagcataaagacgataaactgccaaagctgaaagcgttgttcaaacaaattctttctgatcgtaatgccatttcctggcttccagaagagttcaacagcgaccaagaggtgttgaacgcaatcaaggactgttatgaacgtttggcggaaaatgtattaggagacaaggtccttaagtctttgttgggttcgttggcggattattcattagatggaatttttatccgcaatgaccttcaacttaccgatatcagccaaaagatgttcgggaactggggggtcattcagaacgcaattatgcagaatattaagcgcgtggccccggctcgtaagcacaaggaatctgaagaagactatgagaaacgtatcgcaggcatcttcaagaaagcagatagcttctctatttcatacattaatgattgcttaaatgaggctgaccctaacaacgcatacttcgtcgaaaattactttgctacttttggcgcagtgaacactcccactatgcagcgcgagaatctttttgcccttgtgcaaaatgcatacacggaggttgctgcattgttgcactctgattacccaactgtaaagcatttagcgcaggacaaagccaatgtatctaagattaaggctttattagatgcgattaagtccttgcagcattttgtgaaacctctgcttggcaaaggtgacgagtctgacaaggacgaacgtttttacggtgagctggctagcttatgggcagagctggacacagtcaccccgctttacaatatgatccgcaactacatgacacgcaagccctactcgcagaaaaagattaagttaaactttgaaaatccgcagttgcttggtgggtgggacgcaaataaagagaaggactatgctacgattatccttcgtcgcaacggtctgtactacttagcgatcatggacaaggattcgcgcaagttgcttgggaaagctatgccctcggatggtgaatgttatgagaagatggtttataaattctttaaggatgtgactactatgatccctaaatgttcgacccagttgaaagacgtccaggcttattttaaggtcaatactgatgactacgtcttaaacagcaaagccttcaacaagccattaacgattaccaaagaggtgttcgacctgaataacgtcctgtatgggaaatacaagaaatttcagaaagggtaccttactgcgaccggagacaatgtgggctacacgcatgctgtcaatgtctggattaagttttgtatggatttcttaaacagctatgactcaacatgcatttatgatttttccagtttaaaaccagaatcatatctgtctttagatgctttctatcaggatgctaatctgttgttatacaaacttagtttcgcacgtgctagcgtcagctacatcaaccaattagtcgaggaaggaaagatgtacttgttccaaatttacaacaaagattttagtgaatactccaagggcacgccaaacatgcacacactgtactggaaagcactgtttgatgagcgtaatctggcagatgtggtatacaaattgaatggccaagccgaaatgttctaccgcaaaaagtcgattgagaacactcacccaacccatcccgcgaaccacccaattttgaacaaaaacaaggataacaagaagaaggaaagtttgttcgactatgacctgattaaggaccgccgttacacggtggataaattcatgtttcatgtccccatcacgatgaactttaagtcggtcgggtcagaaaatattaatcaggatgttaaggcctatcttcgccacgctgacgacatgcacatcattggaattgaccgtggggaacgccatttgttgtatcttgttgtgatcgatctgcaagggaacattaaagagcaatattcgcttaatgagatcgtcaacgagtacaatggaaacacgtaccatacgaactatcacgaccttctggatgtgcgcgaggaggaacgccttaaagcacgccaaagttggcagacgatcgagaacattaaggaacttaaagagggctacctttcgcaggtaatccataaaattacgcaattaatggtgcgttaccatgctatcgtcgtgttggaggacttatccaaggggtttatgcgctctcgtcaaaaagttgagaaacaagtttatcagaaatttgagaaaatgcttattgataaactgaactacctggtggacaagaagacagatgtttccacgcctgggggtcttttgaacgcgtatcaattaacctgtaagtccgactcttctcaaaaattagggaaacagtccgggtttttattctatatccctgcgtggaatacttctaaaattgatcctgtaacaggcttcgtaaacttactggatacccattcactgaattcaaaagagaagattaaagcatttttctccaaatttgatgctattcgctacaataaagataaaaaatggtttgaatttaatttagactatgacaagtttgggaaaaaagcggaagatacccgtactaaatggacattgtgcactcgtggcatgcgtatcgacacctttcgcaacaaagagaaaaactcacagtgggataaccaggaggtagacttaacgacggagatgaagagtttgttggagcattactacattgatatccatggaaatctgaaggatgccatctcggcccaaaccgataaggcgttcttcaccggcctgttgcatatcttgaagttgacacttcaaatgcgtaactctattacaggtacagagaccgattatttggtttcacccgttgcggatgagaacggaatcttttatgattctcgctcgtgcggcaaccaacttccagagaatgccgatgcaaatggcgcgtacaatattgctcgcaaaggattaatgcttatcgaacaaatcaaaaatgcggaagatttgaataacgtaaaattcgacatctcaaacaaagcctggttaaatttcgcgcaacagaagccctacaagaacggttga

SEQ ID NO: 55 - DNA, 3825 bp, Prevotella copri
atggctaagaattttgaagattttaagagactttattctctttcaaagactttgcgctttgaagcgaagcctattggtgccactttggataatatagtcaaaagtgatttgctggatgaagatgaacacagagctgcaagctatgtgaaggtgaagaaattgattgatgaatatcacaaggtatttattgatagagtgttggatgatggctgtttgcctttggaaaataaaggtaataataattcattggcagaatattatgagagctatgtatctagagcgcaagatgaggatgcaaaaaagaagtttaaggaaatacagcaaaatcttcgttctgtcattgcgaaaaaactaaccgaagataaggcttatgctaatttgtttggtaacaaacttatagagtcgtataaggacaaagaggataagaaaaagataattgattcagatttgattcaattcatcaataccgcagaatcaactcaacttgattctatgtcacaagatgaggccaaagaacttgtgaaagaattctggggctttgttacttatttttacggcttctttgataatcgtaaaaatatgtatacggcagaagagaagtcaactggtattgcttatcgactagttaatgaaaaccttccaaaattcattgataatatagaggcttttaatagagctataaccagaccagagatacaggaaaatatgggagtcttgtattcagatttttccgaatacttaaatgttgagagtattcaggaaatgttccagcttgactattataatatgttgcttactcaaaagcagattgatgtctataatgctataattggtggaaaaactgatgatgaacacgatgttaagattaaaggtatcaacgattatatcaatctctacaatcagaagcataaagatgacaaattaccaaaacttaaggcattgtttaagcagattcttagtgatagaaatgcaatatcttggttgccagaagagttcaatagtgatcaggaagtcttgaatgctatcaaggattgttatgagcgattgtctgaaaatgttttgggtgataaggttctcaagtctatgcttggttctttggcagattattctcttgatgggatatttatccgtaatgacttacagttgactgatatttctcagaagatgtttggaaattggagcgtgattcaaaatgccattatgcagaatataaagcatgttgctcctgccagaaaacataaggaatctgaggaagaatacgaaaatagaattgctggtatattcaaaaaggcagatagctttagtatcagctatatagatgcttgtttgaacgaaacagacccaaataatgcctactttgtagagaactattttgcgacattgggtgcagtagatactccaacgatgcagcgtgagaacttgtttgcgcttgttcaaaatgcatatactgagataacagcattactccattctgattatccaactgagaaaaatttagcacaggacaaggctaatgttgctaaaatcaaagcattgttggatgcgattaagtctttgcaacatttcgtaaagcctctgttggggaagggagatgaaagtgataaagatgaacgtttctatggtgaattggcttcgttgtgggcagaacttgatacaatgacaccgctgtataatatgattcgtaattatatgactcgtaagccatattcccaaaagaagatcaaacttaactttgagaatcctcaattgcttggggggtgggatgcaaataaggagaaagactatgctaccattatcttacgtcgtaatggtttgtattatcttgctattatgaacaaagactcaaagaaattattgggtaaagcaatgccttctgatggggagtgctatgaaaaaatggtatataagttattgcctggtgctaataagatgcttccgaaagtgttctttgctaaatcaagaatggaagattttaagccaagtaaggaacttgttgagaaatattacaatggtactcacaaaaagggaaagaatttcaatattcaagattgccataatttgatagattactttaagcagtctattgataagcatgaagactggagcaagtttggatttaaattctcagatacttctacatacgaagaccttagtggattctatcgtgaagtagaacagcagggttataagttgtcttttgcaagagtatctgtttcgtatatcaaccagcttgttgaggaggggaagatgtatctgttccaaatctacaataaggatttctctgagtatagcaaaggtactccaaatatgcatactctttattggaaagcattgtttgatgaacgtaatctggcagatgttgtttacaagcttaatggacaggcagagatgttctatcgtaagaaaagtatagaaaatactcatccaactcatcctgctaatcatcctattctgaataagaataaggataataagaaaaaagaaagcttgtttggctatgatcttataaaagatcgtcgctatactgttgataaatttttgttccatgtgccaatcacaatgaactttaaaagttctggttctgagaacatcaatcaagatgtgaaggcgtatttgcgtcacgcagatgatatgcatattattggtattgatcgtggcgaacgccatttgctttatttggttgtaattgatttgcaaggaaatatcaaggaacagttctcgcttaatgaaattgtgaatgattataatggtaatacctatcataccaattatcacgatttgttggatgttcgtgaagacgaacgactcaaagctcgtcaaagttggcagaccatagagaatatcaaagagctgaaagagggctatttgtctcaggttatccacaagattacacagctcatggttaaatatcatgccatagttgtattggaggatttgaacatgggatttatgcgtggtcggcaaaaggtagaaaagcaagtatatcagaaatttgagaaaatgttgatagaaaagctaaactatttagttgacaagaaggctgatgcttctgtttctggaggtttgttgaatgcataccagttgactagcaagtttgatagtttccaaaagctaggaaaacagagcggattcctgttctatattcctgcatggaatacatctaagatagacccagttacaggatttgtcaacttgttggatactcgatatcaaaatgtagaaaaggcaaaaagtttcttctctaagtttgatgctatccgttataataaggataaggaatggtttgagtttaatctcgactatgacaaatttggtaaaaaagcagagggtacaaggactaagtggactttatgtactcgaggaatgcgtattgatactttcagaaataaagaaaaaaactcacaatgggacaaccaggaagtagacttgactgctgagatgaaatctttattggagcattattatattgacattcatagtaatctcaaggatgctatcagtgcgcaaacagacaaggccttctttacgggattgctacacattttgaagttgaccttgcagatgcgtaatagtatcactggaacagaaactgattatctggtatctcctgttgtcgatgagaatggaatattctatgatagtcgttcttgtggtgatgaacttcctgagaatgcggatgctaatggtgcttataatatcgctcgtaagggactgatgatgattgagcagataaaagatgctaaggatttggataacttgaagtttgatatttccaataaggcttggctcaattttgcacaacaaaagccatataagaatggatga

SEQ ID NO: 56 - DNA, 3825 bp, Artificial Sequence
  Description of Artificial Sequence: Synthetic polynucleotide
atggcgaaaaatttcgaggacttcaagcgcttatactccttatccaagacgttgcgctttgaggcaaaaccaatcggcgccaccttagataatatcgtcaaatccgacttacttgacgaggatgaacatcgtgcagcttcttatgttaaagtcaaaaagttgattgacgagtaccacaaggtcttcattgatcgtgtcctggacgacggctgcttacccttagaaaacaaaggaaataataacagcttggctgagtattatgagtcctatgtgagtcgtgcgcaggatgaagacgcgaagaagaaattcaaagaaattcagcagaatctgcgctccgtaattgcaaaaaaattgactgaagacaaagcttacgcgaacttattcggcaataaattgatcgaatcatataaagacaaagaagataagaaaaagatcattgactccgatcttattcaatttatcaacaccgccgaatccacacaattggatagcatgagtcaggacgaggccaaagaactggttaaagagttttgggggtttgtcacgtatttttatggattcttcgacaaccgcaaaaatatgtatactgccgaagagaaatccacaggtattgcatatcgtcttgtcaacgagaacttacccaaattcattgacaatattgaagcctttaaccgcgctatcacgcgtccagaaattcaggagaacatgggcgtgttgtatagcgacttttcggaataccttaatgttgagtcgatccaggaaatgttccaacttgactactataacatgctgctgactcaaaaacaaatcgacgtttataatgcgattatcgggggcaaaaccgacgatgaacatgacgtaaagatcaagggcattaacgactacattaacctgtataatcagaaacataaggatgacaaattgccgaagttgaaggctttgttcaagcaaatcctttcggaccgtaatgcgatctcatggttaccagaagaattcaattcagatcaagaagttctgaacgccattaaggactgttatgaacgcctgtcggaaaatgttcttggggataaggttttaaagtctatgcttggctctcttgctgattattccttagacggtattttcattcgcaatgatctgcaattgacggacatcagtcagaagatgttcgggaactggtcggtcatccagaatgcgattatgcagaacattaagcacgtggcgccggcacgcaaacataaagagagcgaggaagaatatgaaaatcgtattgcgggtatttttaagaaagcggattcattttctatcagttatatcgatgcctgccttaatgagactgaccccaacaatgcgtactttgtagagaactatttcgcgactctgggggccgtggatacaccaaccatgcagcgcgaaaatcttttcgcgctggtacaaaacgcatacacagaaatcacggcgttgttacattctgactatccgaccgaaaaaaatttggcacaagacaaggccaacgtcgcgaaaatcaaggcgctgcttgacgctatcaaaagcctgcagcactttgtcaagcctttgttaggaaagggagacgaatcagataaagacgagcgcttttatggcgagttggcttcgttgtgggccgaattggataccatgacgcccctttacaatatgatccgcaactacatgactcgtaagccctatagccaaaagaaaatcaagttaaatttcgagaatccacaattactgggcgggtgggatgccaataaggagaaagattacgctacaattattttacgtcgcaacggcttgtactatcttgccatcatgaacaaagatagcaaaaagttactgggaaaagcaatgccttcggacggtgagtgttatgaaaaaatggtgtacaaacttttaccaggagctaataagatgttacccaaggtgtttttcgctaagagccgtatggaagacttcaagccctcaaaagaattagtggagaagtattacaatggaactcacaagaagggtaagaatttcaacattcaggattgccataatctgatcgactattttaaacaatctattgataagcatgaggactggagtaaatttgggtttaagttcagcgatacgtcgacatatgaggatctgtctggcttttaccgtgaagtggaacaacaaggctataaattgagtttcgcccgcgtctctgtatcatacattaatcaattggtggaagaaggcaaaatgtatctttttcagatctacaacaaagatttttcagaatattctaaagggacgcctaacatgcataccttatattggaaggctttgtttgatgaacgtaatctggctgacgttgtctacaaattaaacgggcaagcagagatgttttatcgcaagaagtctattgagaacacgcaccccacacaccccgccaatcaccctattctgaataagaacaaggacaataagaaaaaagaaagtttgttcgggtatgacctgatcaaagaccgccgttatacggtcgacaagtttcttttccacgtgccgattaccatgaattttaaatcttctgggtccgagaacattaaccaagacgtcaaggcctatcttcgccatgcggatgacatgcatattattggtattgaccgcggtgagcgtcatcttttatatcttgttgtcatcgatttacaaggcaatattaaagagcaattttcgttgaatgagattgttaatgactacaatggtaatacctatcacaccaattaccatgatcttttggacgtccgtgaggatgagcgtcttaaagctcgtcaaagctggcaaacgattgaaaatattaaggaactgaaagaaggttatttgtctcaggtcatccacaagatcacccaacttatggtaaaataccatgcaatcgtggtgttggaagatttgaatatgggtttcatgcgcggacgccaaaaggtagaaaaacaggtgtatcagaaattcgagaagatgttgattgagaagttgaactatttagtcgacaaaaaggcagatgcgtctgttagtggcggtctgttaaacgcttatcagttgacaagtaaatttgacagcttccaaaaactgggaaagcagtcaggtttcttattctacatcccggcctggaatacgagtaaaatcgatcctgtaacaggattcgtgaatttattagacactcgttatcaaaatgtagagaaggctaagtcgttctttagtaaatttgacgctatccgttataataaggacaaggaatggtttgaatttaacttggactacgacaagttcggtaaaaaagccgagggtacccgcactaagtggaccttatgtacacgtggaatgcgtatcgacacctttcgtaataaggagaaaaattctcagtgggataatcaggaggttgatttgacggctgagatgaagagtctgcttgagcattactatattgatattcattcgaatctgaaggacgcaatctcagctcagactgacaaggccttttttaccgggttacttcacatcttgaaattgacactgcaaatgcgcaatagtattaccgggactgaaactgactacttagtgagtccggtagttgatgaaaacggaattttctacgattcacgctcatgtggcgatgagttgccagaaaatgcggacgctaacggtgcttacaacatcgcccgtaaaggtttaatgatgatcgagcaaattaaagacgctaaggacttagacaatttgaagttcgatattagtaataaggcgtggttgaatttcgcccaacaaaagccgtataaaaatggttga

SEQ ID NO: 57 - DNA, 3825 bp, Artificial Sequence
  Description of Artificial Sequence: Synthetic polynucleotide
atggcaaaaaattttgaagactttaagcgtttatacagtttgtccaagactttacgttttgaggctaaacctattggcgcaaccctggacaacattgtaaagtctgaccttctggacgaagatgaacaccgtgccgcctcttacgtaaaagtcaaaaaattgatcgacgaatatcataaggtcttcatcgatcgcgtgcttgacgacggctgtttacctctggagaataaaggtaataacaattccctggctgaatattacgaaagctacgtcagtcgcgctcaagacgaagacgcaaaaaaaaagttcaaggaaattcaacaaaatcttcgctccgtgattgccaagaagctgacagaagataaggcatacgccaacctgttcggtaacaagttgatcgagagttacaaagataaagaggacaagaagaaaatcatcgatagcgatctgatccaattcatcaatacagcggagtcaacccagctggactctatgtcccaggatgaagctaaagaacttgtgaaggaattctggggtttcgtaacctatttttatgggttcttcgacaatcgcaaaaatatgtacactgccgaggaaaagtcaacaggaatcgcatatcgcttggtgaatgagaatttaccaaaatttatcgacaatattgaggccttcaatcgcgcgatcactcgtccggaaattcaggagaacatgggtgtcttatactctgatttctcggagtaccttaacgtagaatctatccaggaaatgtttcagcttgattactacaatatgctgttgacacagaaacagattgacgtgtataatgcgatcattggtgggaagaccgatgacgaacatgatgtcaagattaaagggatcaatgactacattaacttgtacaatcagaaacataaagacgacaagttgccgaagttgaaggctttatttaagcaaatcctttcggatcgtaacgctatctcgtggttacccgaggagttcaatagcgatcaagaagtcttgaatgcaattaaggattgttatgagcgcttatcagagaacgtattaggagacaaagttcttaaaagcatgttgggctcgcttgctgactacagtttggatggcattttcattcgtaacgatttgcaattaacagatatttcgcaaaaaatgttcggaaattggagcgtcatccagaatgctatcatgcaaaacatcaagcacgtggctcccgcacgtaaacataaagagtctgaagaagagtatgaaaatcgcattgctggaatttttaaaaaggcagatagctttagtatttcctatatcgacgcgtgtttgaatgagacggacccaaacaatgcctatttcgtagagaattattttgctaccctgggggcagtagatacaccgacaatgcaacgtgaaaatctttttgcgcttgtccagaatgcgtacacagaaatcacggcgctgttgcactctgactatcctactgaaaaaaatcttgcgcaggacaaggccaacgtggcaaaaatcaaggcacttcttgatgctattaaaagcttacaacacttcgttaagcccctgctgggcaaaggggacgaaagtgataaagacgagcgcttttatggggagttagcttcgctgtgggctgagctggataccatgacgcctttatataacatgatccgcaactacatgacacgcaaaccttattcacaaaagaagatcaagcttaattttgaaaatccgcagttgctggggggatgggatgcgaataaagagaaggattatgccaccattattcttcgtcgtaatggcttatactatttggcaatcatgaataaggactccaagaagttgctgggcaaagctatgccgagcgatggagaatgctatgagaaaatggtctataagttgttaccaggtgcgaacaagatgttaccaaaggtttttttcgcaaagtcgcgcatggaagattttaaaccttccaaagaattagtagaaaaatattataacggcacgcacaagaagggcaagaatttcaatattcaggactgtcacaatctgattgattactttaaacagtcgattgataaacacgaggattggtctaaatttggttttaagtttagcgatacctcgacttatgaagacctgtcaggattttatcgcgaagtcgagcagcagggatataagttgtcatttgctcgtgttagcgtatcgtatattaatcagttggtagaagaggggaagatgtatcttttccaaatctacaataaggatttttcggagtattcaaagggaacaccaaatatgcacaccctgtattggaaggctttattcgacgagcgcaatcttgcagacgtcgtctataagcttaatggacaagcggaaatgttctaccgcaaaaagtccattgagaatacacaccccacgcacccggctaatcacccgattctgaataaaaacaaagacaacaaaaaaaaggaaagcttatttggctacgacttaatcaaagaccgccgttacacagtagacaagttcttgtttcacgtgcctattacaatgaattttaaaagtagcggttcagagaatattaaccaagacgtgaaagcgtacttacgtcatgccgatgatatgcacattatcggtattgaccgcggagaacgtcacttattgtacttggtggttattgatttacaagggaacatcaaagagcagttcagtttgaacgagatcgtgaatgactacaatggtaatacgtatcatactaactaccatgatcttttggacgtgcgtgaggatgagcgcctgaaagcccgtcagagctggcagaccatcgagaatatcaaagaattgaaggaaggctacttatcgcaggtcattcataaaatcacgcaactgatggtgaaataccacgcgattgttgttttggaagatctgaatatggggtttatgcgtggccgtcagaaagtggagaagcaagtttaccagaaatttgaaaagatgttgattgagaagttaaattacttggtagacaagaaagcagacgcgtctgtatctggaggtttgcttaacgcataccagttgacgtcaaagtttgatagttttcaaaaattagggaaacaatccggatttctgttctacattcccgcatggaacacgtcaaaaattgacccggtgaccggcttcgttaacttattggacactcgttaccaaaatgtggagaaagccaagtcttttttctctaaattcgacgcgattcgttacaacaaggataaagaatggtttgagtttaacttggattatgataagtttgggaagaaagcagaaggaacgcgtactaaatggacactttgtacacgtggaatgcgcatcgatacgttccgcaataaagaaaagaactcccaatgggacaatcaagaggttgatttaactgcagaaatgaagagtttacttgagcattactacattgatatccactcaaaccttaaagatgcaatctctgctcaaactgataaagcgtttttcacgggattactgcatatccttaagttaacgttacagatgcgcaatagtatcaccggtactgaaacagattatcttgtctctccggtagtggacgagaacggcattttttacgacagtcgttcgtgcggggacgaattgcctgagaatgcggatgctaatggggcgtataacattgcgcgcaaagggcttatgatgatcgaacagatcaaagacgctaaggacctggataacttgaagtttgatattagcaataaggcttggctgaacttcgctcagcaaaaaccatataagaatggctga

SEQ ID NO: 58 - DNA, 3825 bp, Artificial Sequence
  Description of Artificial Sequence: Synthetic polynucleotide
atggccaagaactttgaggactttaagcgtttgtactccttaagcaagaccctgcgtttcgaggcgaagccaattggggctacgttggataacatcgtcaaatctgatttgttggatgaagacgagcaccgtgcagcttcgtatgtaaaagtaaaaaagttaattgatgagtatcacaaagtattcatcgaccgcgtactggacgacggatgcttacccttagagaacaaaggcaacaacaattctttggcggaatactatgaaagctatgtaagtcgtgctcaggatgaggatgcgaagaagaagtttaaagaaattcaacagaacctgcgctcagtgatcgcaaaaaaattgacggaggacaaggcctatgctaatttgttcgggaataaacttattgaatcatataaagataaagaggataagaagaaaattattgatagcgatctgattcagttcatcaatacagcggaatcgacgcaattggatagtatgtcgcaggacgaagcaaaggagttggtcaaagaattttggggcttcgttacttacttctacgggtttttcgataaccgtaaaaacatgtatactgcggaagaaaaatccactgggattgcctatcgtctggtgaatgagaatctgccaaaatttatcgacaatatcgaggcttttaatcgtgcaatcacacgccccgagattcaggaaaatatgggggttttatattcggattttagtgagtatctgaatgttgaatctatccaggaaatgtttcagcttgactactacaatatgctgcttactcaaaagcagatcgatgtttataatgcaatcattggaggcaagactgatgacgaacatgatgtaaagattaaaggtatcaatgactatatcaatttatacaaccagaaacataaggacgataaattgccaaaacttaaagctctttttaagcagattctttcagaccgtaatgcaatttcatggcttccggaagaattcaattccgaccaggaggtcttaaacgcgattaaagactgttatgagcgtttaagtgaaaacgttttaggtgataaagtacttaagtcaatgttgggatcgcttgcagattattccttagacgggatctttattcgtaacgaccttcagcttacggatatctctcaaaaaatgtttgggaattggtccgtcatccaaaacgccatcatgcaaaatattaaacacgttgcccctgcgcgtaaacacaaggaaagtgaggaagagtatgaaaaccgtattgcgggaatctttaaaaaagcagattctttttcaatcagctatattgatgcctgcctgaacgagactgaccccaataatgcttacttcgtagaaaactatttcgccactttgggtgcggtagacacccctacaatgcagcgtgagaacttgtttgcgctggtgcaaaacgcgtatacggaaattacagctcttcttcattcggattaccctactgaaaaaaaccttgcccaggacaaagccaacgtggcaaaaatcaaagcgttactggacgcaatcaaatctttgcaacattttgtaaaacctctgctggggaaaggcgatgagagcgataaggatgagcgcttctatggcgagctggcaagcctttgggctgagcttgacacgatgacgccgctttacaacatgattcgcaattatatgacccgcaaaccgtatagtcaaaaaaagattaagttaaactttgaaaacccccagctgctgggcgggtgggacgctaataaagagaaagactatgcgacaattatccttcgtcgcaatggcctgtactacttagcaatcatgaataaggactcaaagaagcttttgggcaaggcaatgccgtcggatggcgaatgttatgagaagatggtttacaagttactgcccggcgccaataaaatgttaccaaaggtctttttcgcaaagtcccgcatggaagatttcaagccctccaaagagttagttgagaagtactacaatggtactcataaaaaggggaaaaacttcaatatccaagactgccacaatcttattgattactttaagcagtccattgacaaacacgaggattggagcaagttcggtttcaagtttagtgatactagcacctatgaagatctttcgggtttctaccgcgaagtcgaacaacagggctacaagttaagttttgcccgtgttagtgtgagctacatcaaccaactggtggaagagggcaaaatgtatctgtttcaaatttataataaagatttctctgaatattccaagggcactccaaatatgcacactctgtactggaaagcattatttgacgagcgcaatcttgcagatgtggtctacaaattgaacgggcaggcggaaatgttctatcgcaagaaaagtattgaaaatacacacccgacacaccctgcaaaccacccaatcttgaacaaaaacaaagacaacaaaaaaaaggagagtttattcgggtacgatctgatcaaggatcgtcgctatacggttgacaaatttcttttccatgttccaattactatgaacttcaaaagctccggctccgagaacatcaaccaagacgttaaagcgtatctgcgtcacgcggacgacatgcatattattgggatcgatcgtggcgaacgtcatctgttatatttagttgttattgatttgcaaggtaatatcaaggaacagttctcattgaatgaaattgtcaacgactacaacggtaacacctatcacactaattaccacgacttgttagacgtccgtgaagatgagcgtcttaaagcacgccagagttggcagacaattgagaacatcaaggaactgaaagagggctaccttagtcaagtgattcacaaaattacccaactgatggttaaataccacgcaatcgtagtcttagaggaccttaacatggggttcatgcgtggtcgtcaaaaagtcgaaaagcaagtatatcaaaaattcgaaaagatgcttatcgaaaaattaaactacttagtggataagaaggctgacgcttcagtctctggtggattgttaaacgcctatcagctgactagcaagttcgacagctttcaaaaattaggcaaacagtccggtttcttattctacatcccggcatggaataccagtaaaattgatcctgtaaccggtttcgtgaacttattggacactcgttaccaaaatgttgagaaagctaaatctttctttagtaaattcgacgctattcgttataataaggataaggagtggttcgaattcaacttggactatgataaatttggcaaaaaagccgaaggtacgcgtactaaatggaccctttgcactcgcggcatgcgtatcgatacatttcgtaacaaggagaaaaactcgcagtgggataatcaagaggtcgatctgacggccgagatgaaatcattattagagcattattacattgatattcactcgaatcttaaagacgccatttcagcccagaccgataaagccttttttacaggcttattacatatcttaaaattgacgttacaaatgcgtaactcgatcactggaactgagactgactacctggttagccccgtggttgatgaaaacgggatcttttacgattcacgtagttgtggggatgaattgccagagaatgctgatgcaaatggtgcatataacatcgcccgcaaaggtcttatgatgattgaacaaattaaagatgcaaaagacctggataatttgaagtttgacattagcaacaaggcctggcttaactttgcacagcaaaaaccttataagaatggatga

SEQ ID NO: 59 - DNA, 3756 bp, Moraxella bovoculi
atgttgtttcaagactttacccatttatatcccttatcaaaaaccgtgcgttttgaattaaagcccattggcaggacattagagcatatccatgccaaaaactttttgagccaagatgagaccatggcggacatgtaccaaaaggtgaaggtgatactcgacgattatcatcgtgattttatcgctgatatgatgggcgaagttaagctaactaagctggcagaattttatgatgtgtatttaaaatttagaaaaaatcccaaagacgatgaattgcaaaaacagctaaaggacttgcaagcagttttaagaaaagagagtgtgaagcccatcggtaatggcggaaaatacaaggcgggtcatgaccgcttgtttggggcaaagctctttaaggacggcaaagagcttggtgatttggcaaaatttgtcatcgcccaagagggtaagtcatcgccaaagcttgctcaccttgcccattttgagaagtttagcacttactttactggttttcatgataaccgcaaaaacatgtacagcgatgaggataaacacaccgccattgcctatcgtctgatacatgaaaacctgccacgttttattgacaacctacaaatactgacaaccatcaaacaaaagcactcggcgttgtatgaccagattataaatgagctgactgcgagtggcttggatgtgtcgctggcaagtcatctggacggctatcacaagcttttaacccaagagggtatcacggcttataataggataataggtgaagtgaatggttatacgaataagcacaatcaaatttgccacaaatccgaacgtatcgccaaattacgccccctacacaaacaaatcctaagcgacggcatgggtgtgtcatttttgccaagcaaatttgctgatgatagcgagatgtgtcaagcggtcaatgaattttaccgccattatgccgatgtttttgccaaggtgcaaagcttgtttgatgggtttgatgaccatcaaaaggacggcatttatgttgagcataaaaatttaaatgaactatccaagcaggcatttggtgattttgccttgttgggtcgggtgctggacggctattatgtggatgtggtgaatccagagtttaatgaaagatttgccaaagccaaaaccgacaatgccaaagcaaaactgactaaagaaaaagacaaattcatcaaaggcgtacactccttggcaagccttgagcaggcgataaagcatcatactgctaggcatgatgatgagtctgtgcaggcgggcaaacttggacagtatttcaaacacggtctggcaggcgtggataatccaatccaaaaaatacacaacaaccacagcaccattaagggttttttggagcgtgaacgtccagcaggcgagcgagcattgcccaaaattaagtcaggcaaaaaccctgaaatgacgcagttaagacagctaaaagagctgctagacaatgccctaaacgtggcgcattttgccaagttattaatgaccaaaaccacgctagacaaccaagacggcaatttttatggtgagtttggggtgttgtatgatgagcttgccaagattcccacgctttataacaaagtgcgcgattatctgtcgcaaaagccatttagcaccgaaaaatataaattaaactttggcaatccgacattattaaacgggtgggatttgaataaagaaaaagataattttggggttatcttacaaaaagacggctgttattatttggcgttattagataaagctcataaaaaagtatttgataatgctccaaatacaggcaaaaatgtttatcaaaaaatgatttataaattattgcccggacctaataaaatgctacccagagtattttttgccaagagtaatttggattattataacccttctgctgaactactggataaatatgcacaaggcacgcacaaaaaaggcgataattttaatctaaaagactgccatgcgttgattgatttttttaaggcgggtattaataaacatccagaatggcaaaattttggttttaaattttcgccaaccagtagctatcgagatttgagtgatttttatagagaagtcgaaccacaaggttatcaagtaaaatttgtggatatcaacgccgattatattgacgagttggttgaacaaggtcagttgtatttattccagatttataataaagatttctcgcccaaggctcacggtaagcctaatttacatactttatattttagggcgttatttagtgaagataatcttgccaatccgatttataagttaaatggcgaggcacagatattttatcgcaaggcgtctttgggtatgaatgaaaccaccattcatcgtgcaggcgagatattagaaaataaaaatcccgataatcccaaagaacgtgtatttacctatgacatcatcaaagatagacgctatacccaagataagtttatgctacatgtgcctattaccatgaattttggcgtgcagggcatgacgattaaagaatttaataaaaaagtgaatcaaagcatacggcaatatgatgatgtcaatgtcataggcatagaccgtggcgagcgacatttgctatatctgaccgtgattaatagcaaaggtgaaatcttagaacagcgtagtctcaatgacatcactaccgcatcagcaaatggcacacaaatgaccacgccttatcataagatactggacaaaagagaaatagaacgcctaaatgctcgtgtcggttggggtgagattgagaccataaaagagctaaaatcgggctatctaagccatgtggtacatcaagtcagccagcttatgcttaaatataatgccattgtggtattagaggatttaaattttgggtttaagcgtggtcgctttaaggtggaaaaacaaatttaccaaaactttgaaaacgccttaatcaaaaagctaaaccatttggaattaaaagataaggcagatgatgagattggctcatacaaaaatgccctgcaattgaccaataattttactgatctaaaaaacattggcaaacaaacaggctttttattctatgtgcctgcatggaataccagtaaaatagaccctgaaacgggctttgtggatttgttaaaaccacgttatgaaaatatcgctcagtcgcaagcgttttttggtaaatttgataagatttgttataacgcagataaggattattttgaatttcatattgattatgccaaatttactgacaaagccaaaaactctcgccaaacatggacgatttgctcgcatggcgataaacgttatgtgtatgacaaaaccgccaatcaaaataaaggagcgaccaagggtattaatgttaatgatgaattaaaatcgctatttgctcgctatcacatcaatgaaaaacagccaaatttggtcatggatatttgccaaaataacgacaaagaatttcataaatcgctgatgtatctattaaagacattgcttgcattacgatatagtaacgccagtagcgatgaagattttattttatcgcctgtggcaaatgatgagggtgtgttttttaattcggcattggcggatgatacacagccacaaaatgcggatgccaatggggcatatcatatcgcattaaagggcttatggctattaaatgagctaaaaaacagtgatgatttgaataaagtcaaacttgccattgataatcaaacatggctaaacttcgctcaaaaccgctaa

SEQ ID NO: 60 - DNA, 3756 bp, Artificial Sequence
  Description of Artificial Sequence: Synthetic polynucleotide
atgttatttcaggatttcacgcatttatatcctttaagcaagacagtccgttttgaattgaagcctattgggcgcacccttgagcacatccatgcaaagaattttttatcgcaggatgaaacaatggcggatatgtaccagaaagtgaaggttatccttgatgactaccatcgcgactttattgctgacatgatgggggaggtcaaattgacgaagttagcggagttttatgacgtctaccttaaatttcgtaaaaatccaaaagacgacgaactgcagaaacagctgaaagatttacaggcggtattacgtaaagaatcggtcaagccaatcggtaatggtggcaagtacaaagcaggccatgatcgtttgtttggtgctaaacttttcaaggacggtaaagaactgggcgacttagctaaatttgtcattgctcaagaagggaagtcaagtcctaagttagcccacctggctcattttgagaaattctccacttacttcacggggtttcacgacaatcgtaagaacatgtatagtgatgaggataaacatacggcaattgcgtaccgtctgattcacgaaaacttacctcgtttcattgataaccttcaaatccttactaccatcaaacagaagcattctgcgttgtacgatcaaatcattaatgaactgaccgcgtccggtttagatgtaagccttgcgtcacacctggatggatatcacaaattattgactcaggaagggattactgcctacaaccgtatcattggggaggtcaatgggtatactaacaaacataatcagatttgccataagtctgaacgtattgccaagttgcgtccgctgcataagcagatccttagcgatggtatgggtgtctcctttttgcctagcaaattcgcagacgacagtgaaatgtgccaagcagtcaatgaattttatcgtcactatgcggatgtctttgcaaaagtgcaaagccttttcgacggtttcgatgatcaccaaaaagacggaatttatgttgagcataaaaatcttaacgagttaagtaagcaggctttcggtgatttcgccctgctggggcgtgttttagacggttactatgtggatgttgttaatcccgaatttaacgagcgcttcgctaaagccaaaactgacaacgctaaggctaaactgactaaagaaaaggacaagttcattaaaggcgttcattcactggcaagcttagaacaagccatcaaacatcacacggcgcgtcatgatgacgagtcggtgcaggctggtaagttagggcagtactttaagcacgggctggcaggagtagataacccaattcaaaaaattcacaataatcattcgactattaaaggatttctggaacgcgaacgcccggccggagaacgtgctttgcccaaaattaaatcgggaaagaaccctgaaatgactcagcttcgtcagctgaaagaattactggacaacgccttaaatgtagcccattttgcaaagttattaatgacgaagaccacgttagacaatcaagacggtaacttctacggtgagttcggcgtcttatacgatgaacttgcaaaaatccctacactttacaacaaagtgcgcgattatctttcccaaaagccattcagcaccgagaagtataagttaaatttcggcaatccaacgttacttaatgggtgggatcttaacaaagaaaaagacaacttcggtgtcattcttcaaaaagacgggtgttactacttggccttacttgataaagcccataagaaagtttttgataacgcccccaatactgggaagaacgtatatcaaaaaatgatttataagttgttaccggggcctaataaaatgttacctcgtgtatttttcgcaaagagtaatttggattattataacccctctgccgagttattggacaagtacgcgcaaggcacacataaaaagggtgataactttaacctgaaagattgccatgctttgatcgacttctttaaggcgggtattaacaagcaccccgagtggcaaaattttggtttcaagtttagcccgacctcctcctaccgtgacctgagtgacttctaccgcgaagttgaaccacaaggctatcaagtcaaattcgttgatattaacgcagactacattgatgaattagtcgagcaaggtcagttatacctgttccagatttacaataaagatttctcgcctaaagcccacggaaaacctaaccttcacacgctttattttcgcgcacttttcagtgaggataatttggctaaccctatttataagttaaatggtgaagcccaaattttctaccgtaaagcctccttggggatgaacgagacaactattcaccgtgcaggggagatcttggagaacaaaaatccggacaacccaaaagagcgtgtttttacttatgacattatcaaggaccgtcgctacacacaagacaagttcatgcttcatgttccgatcacgatgaatttcggcgtgcagggtatgacaatcaaggaatttaacaagaaagtgaaccaaagtattcgccagtatgatgatgtcaacgtgattggaattgaccgcggggaacgtcatttattgtacctgaccgtgattaatagcaaaggagagatcctggaacaacgcagcctgaatgatatcacaacagcctcagcgaacggaacccaaatgacaacaccctatcataagattctggataagcgcgaaatcgaacgcttaaatgctcgtgtcggctggggtgagatcgagacaatcaaggagctgaaatccggctacctgtcgcatgtagttcaccaagtctcacaattgatgcttaagtacaacgcaattgtagttcttgaagatttaaactttggttttaaacgtggccgctttaaggttgaaaagcagatctaccagaactttgaaaacgcccttatcaaaaaattaaatcaccttgagttgaaagacaaagcggacgacgaaatcggttcatacaaaaatgcattgcaattgacgaacaattttaccgatctgaaaaatattgggaaacagacgggtttcttgttttatgtccctgcgtggaacacgtctaagattgacccggagacagggtttgtcgacttattaaaaccacgctacgagaatattgcacagtcccaggcctttttcggaaagtttgataagatttgctataacgcagataaagattactttgagttccacatcgattatgccaaatttaccgacaaggcaaaaaattcccgtcaaacctggacaatttgctcgcacggcgacaaacgttacgtttatgacaaaacggcgaatcaaaataaaggcgctactaaggggatcaacgtaaatgacgagttaaaatcattattcgcccgctaccatattaacgaaaagcaaccaaatttagtgatggacatctgccaaaacaacgacaaggagttccacaagtctcttatgtatcttctgaaaacacttttggcgcttcgctactcgaatgcgtcgtccgatgaggacttcatcttatctccggtggctaatgacgagggtgtctttttcaattctgcattggccgatgacacgcaaccgcagaacgctgacgccaacggggcatatcacattgcgttgaaaggcctttggctgctgaacgagttaaagaattccgacgatctgaataaagtgaagctggccattgacaaccaaacgtggcttaatttcgcacaaaatcgctaa

SEQ ID NO: 61 - DNA, 3756 bp, Artificial Sequence
  Description of Artificial Sequence: Synthetic polynucleotide
atgctgttccaggattttacccacttgtaccctctgagcaagacggttcgttttgaattgaagcctattgggcgcactttggagcatattcacgcaaaaaatttcttgtcgcaagacgaaactatggcggacatgtaccagaaagtcaaggtgatcctggatgattatcatcgtgactttatcgcagatatgatgggggaggttaaacttaccaaattagctgaattctatgacgtctacttgaagttccgcaaaaacccaaaggacgatgagttgcaaaaacaacttaaggacttacaagctgtccttcgtaaggagagcgtgaaaccaattggtaacggcgggaaatacaaggctgggcatgaccgtttgtttggagcgaaactttttaaggatggtaaggaacttggagatcttgccaaatttgttattgcccaggaagggaaatcctcgcccaaattagcgcaccttgcccacttcgagaagtttagcacatactttacggggtttcatgataaccgcaagaatatgtactcggatgaagataaacataccgctattgcttaccgcctgattcacgagaatttaccgcgctttatcgataaccttcagattttgactacaattaaacagaagcatagtgcattgtacgatcagattatcaacgagcttacagcgtccggtcttgacgtaagcttggcatcccatctggacggatatcataaattattaacacaggaagggattacagcatacaaccgcattattggagaagttaacgggtatacaaataaacataaccagatctgccacaagtcagagcgcattgcaaaacttcgtccccttcataaacaaatccttagtgacgggatgggcgttagtttcttgcctagtaaattcgcggacgattccgaaatgtgtcaagcggtaaacgaattttaccgccactatgctgacgtttttgcaaaggtacaaagtttattcgatggtttcgatgaccaccaaaaggacggtatctatgttgaacacaagaacttaaatgagttatctaaacaggcattcggtgattttgccttattgggccgtgtcttggacggttactatgtggatgtggtaaacccagaatttaatgagcgttttgctaaggccaaaacagataacgcgaaggcgaagttaaccaaagaaaaggataaatttatcaagggtgtacatagtttggcctccttggaacaagctatcaaacaccatacggcgcgtcatgacgatgagtctgtccaagctggcaaattggggcaatacttcaagcacgggttagctggtgtggataatcctatccaaaagatccataataaccattcaactattaaaggtttcttagaacgtgaacgtcccgcgggagaacgtgcactgcctaagattaaatcgggtaagaacccggaaatgacacaattgcgccaattgaaggagctgctggataacgctttgaatgtagctcattttgccaagttactgatgacgaagaccacgttggacaaccaagatggcaatttctatggagaatttggtgttttatatgatgagttggcaaaaatccccacactgtacaataaggtccgcgattatttgtcacagaaacccttttctactgagaaatacaaactgaatttcggaaatccgacattactgaacggctgggacctgaataaggaaaaagacaatttcggcgtcattctgcagaaagatggctgctactaccttgcacttctggacaaagcacacaaaaaggtgtttgataacgcacccaatacaggtaagaatgtataccaaaaaatgatttacaagcttttacccggacctaacaaaatgttaccccgtgtctttttcgctaaatcaaatctggattattacaaccccagcgcggagcttcttgacaagtatgcacaaggtacgcataagaagggggataattttaacttaaaagattgccacgctctgatcgattttttcaaagcgggcattaacaaacatcctgagtggcaaaatttcggtttcaagttcagccctacctcttcatatcgcgatctttccgatttttaccgtgaagttgaaccgcagggctatcaggttaagtttgttgatatcaacgctgactatattgatgagttggtggagcaagggcaattatacttatttcagatctacaataaggatttttcaccaaaagctcacggtaaaccgaatcttcacacactgtacttccgcgcgttatttagcgaggataatcttgctaatccaatttataaactgaatggtgaagctcagatcttttaccgtaaggcaagccttggaatgaacgaaacgactatccatcgcgccggagaaattttggaaaataagaacccagacaatcccaaagagcgcgtctttacctacgatatcatcaaagaccgccgctacacgcaagacaaattcatgctgcacgtccctattaccatgaactttggcgttcagggaatgactattaaggaattcaataaaaaggtaaatcagtcaatccgccagtacgacgatgtaaatgttatcggtattgatcgcggggagcgccaccttttgtaccttaccgtgatcaattctaaaggcgaaattcttgaacaacgctcactgaacgatattaccacagcttctgcaaatggcactcaaatgacgacaccctaccacaaaattctggacaaacgcgagatcgaacgtttaaacgcccgtgttgggtggggagagattgagaccattaaggaattgaaatcaggatacctgagccatgtagtgcatcaagtatcccagttaatgttgaagtataatgcaatcgttgtcttagaagatctgaactttgggttcaaacgtggccgcttcaaagtagaaaagcaaatctatcaaaacttcgaaaatgcgttgatcaaaaagcttaaccacctggaattgaaggataaggcggatgatgagattgggagctacaaaaatgctcttcaacttacgaataacttcacagatctgaaaaacattggaaagcaaactgggtttctgttctatgtgcccgcgtggaatacgtctaagatcgatccagagacagggtttgtcgatctgctgaagccgcgctacgagaacatcgcccaaagtcaagctttcttcggaaagtttgataaaatctgctataacgcagataaggactacttcgaattccacattgattatgcgaagtttacggataaggctaagaactctcgtcaaacttggaccatttgctcccatggagataagcgttacgtatatgataagactgcaaaccaaaataagggtgcgacaaaggggatcaacgtcaatgacgaattaaaatctttgttcgcacgttaccatatcaacgaaaagcaaccgaatctggtgatggacatctgtcaaaataacgacaaggaatttcataagtccttgatgtacctgttaaaaactctgttagcgttacgctattctaatgcctcttcagatgaagattttatcttatcaccggtcgccaacgacgaaggcgtctttttcaattccgctctggcggatgacacgcaacctcagaatgccgacgcgaacggggcgtatcacatcgccctgaagggtttgtggctgcttaatgaattgaagaactcggatgacttaaacaaagtcaagctggctatcgataaccaaacatggttaaattttgcacaaaaccgttaa

SEQ ID NO: 62 - DNA, 3756 bp, Artificial Sequence
  Description of Artificial Sequence: Synthetic polynucleotide
atgctttttcaggactttacacacttgtacccactttccaagaccgtacgtttcgaactgaaaccaatcggccgcacactggagcacatccacgcaaaaaacttcctttctcaagacgagacaatggcggatatgtatcaaaaagttaaggtaattcttgacgactaccaccgcgatttcatcgcggacatgatgggggaggttaagctgacgaagttagcagaattctacgacgtataccttaagttccgcaaaaacccaaaggacgacgaattacaaaagcaacttaaggacttacaggcagttttacgcaaagagagcgttaaaccgattggtaacggtggcaaatataaggcaggacatgatcgtctttttggggcgaagctgttcaaggacggtaaggaattaggtgatcttgcgaaatttgttatcgcacaagaaggtaagtcatcaccgaagttggcgcatcttgcacattttgagaaattttctacgtatttcactgggttccacgataatcgtaaaaatatgtactcagatgaggacaagcacaccgccattgcatatcgcttaatccatgaaaaccttccgcgtttcattgacaacttacaaatcttaactacgatcaaacagaaacattccgctctgtatgaccaaatcattaacgaacttaccgctagcggtttagatgtctcactggcgtcacatctggatgggtaccacaagctgcttacacaggagggcatcaccgcctataatcgtatcattggcgaggtcaatggttatacaaacaagcacaaccaaatctgtcacaaatccgagcgtattgccaaactgcgcccgcttcacaaacaaattttatcagatgggatgggagtttcctttttgccctccaaattcgcggacgatagcgaaatgtgccaggcagttaacgagttctaccgtcattacgcagatgtttttgctaaggtccagtcgctttttgatggttttgatgatcatcaaaaagatggaatttacgtagaacacaagaatttaaacgagctgtccaagcaggcattcggtgattttgctttgcttggccgcgtattagacgggtattatgtcgatgtagtgaacccagaatttaacgagcgtttcgccaaagctaaaacggataatgcgaaggcaaaattgacaaaagagaaggataaattcatcaaaggagtgcacagccttgcgtccttggaacaggccatcaagcaccatacggcccgtcacgatgatgagtccgttcaggcgggcaaattggggcaatactttaagcacgggttagccggagtggacaatccaattcaaaagattcacaacaaccattcaacaatcaagggctttttagagcgtgagcgtcccgccggagagcgtgcactgcctaagattaaatccggcaagaatcctgagatgacacagttgcgccaactgaaggaactgttagacaacgctctgaacgtagctcatttcgcgaagttgttgatgacgaagaccaccttggataaccaagacgggaatttttatggtgagttcggggttttgtacgacgagctggccaagattcccactttgtacaataaagtacgcgattacctttcccaaaagccgttcagtacagaaaagtacaaacttaactttggtaatcccacgttgcttaatggctgggatcttaacaaagagaaagacaattttggagtcatccttcaaaaggacggctgctactatttggcattgttagataaggcacataaaaaagtgtttgacaacgcacctaacacggggaaaaacgtataccagaagatgatctataaattattacctggcccgaataagatgctgccccgcgtcttcttcgcgaagagtaacttagattattacaatcctagtgctgagttgttggataagtacgcgcaaggaacccacaagaagggagacaactttaacttgaaggactgccacgcactgattgattttttcaaggcaggcattaacaagcatcctgagtggcagaatttcggcttcaagttcagtccaacgtcgagctatcgtgacttatctgacttttatcgcgaggtagaaccccaaggatatcaggtaaaattcgtagatattaacgcggactacatcgacgagttagtggaacaaggccagttatacctgtttcagatttacaataaggatttttcacctaaagcgcacgggaaaccgaaccttcacaccctttattttcgtgctttattctctgaagataaccttgcaaatccgatttacaagttaaacggagaggcccagatcttctaccgcaaggcaagcttaggaatgaacgaaacaactatccatcgcgcaggtgaaatcctggagaacaagaaccctgacaacccaaaggaacgtgtgtttacgtacgacatcattaaagatcgccgttatacccaagacaagtttatgctgcatgttcctattacaatgaacttcggcgttcaaggcatgaccattaaggagttcaacaaaaaggtaaatcaatctatccgtcaatacgacgacgtgaacgtcatcggaatcgaccgcggagaacgtcatcttctgtatcttacggtcatcaacagcaagggggaaatcttggagcaacgcagtcttaacgacatcacaacagcatcagctaatggcacccaaatgacaactccctaccataagattcttgacaaacgtgaaattgaacgccttaatgctcgtgtaggttggggagaaattgaaacgatcaaggagctgaagtccgggtatctttctcatgtggtccatcaagtatcacaattgatgctgaaatacaatgcgattgtagtcttggaagacttaaacttcggtttcaagcgcgggcgctttaaagtggaaaagcaaatttaccaaaattttgaaaatgcactgatcaaaaagcttaatcatctggagcttaaagacaaagcggacgacgaaattggcagctataaaaacgcactgcaactgacgaacaatttcacggatttaaaaaatatcgggaaacagacgggtttcttattttacgtcccggcttggaatacaagcaagattgatcctgaaacaggtttcgtcgacttgcttaagcctcgttacgagaacattgcgcaatctcaagcattcttcggtaaattcgataagatttgctataatgctgataaggattacttcgagttccacatcgactatgccaagttcaccgacaaagcaaaaaatagtcgtcaaacatggacgatctgctcgcatggggacaagcgttatgtttacgataagaccgcgaaccaaaacaaaggggcgacgaaaggcattaacgtaaatgatgagcttaaatcattattcgcccgctaccacatcaatgaaaaacaacccaacctggtgatggatatctgtcaaaataacgataaggaatttcacaagagtttaatgtacttacttaaaacgttgctggcgttacgctactcgaacgcttcgtccgatgaggatttcattctgtctccagtggccaatgacgaaggcgtgtttttcaatagcgcactggctgacgatacgcaaccgcagaatgctgatgcgaacggtgcctaccatatcgccttaaaaggcctgtggctgctgaatgaattaaagaattcggacgaccttaacaaagtaaagttagctatcgacaaccagacttggcttaattttgctcagaaccgttaa

SEQ ID NO: 63 - DNA, 3756 bp, Moraxella lacunata
atgttatttcaagactttactcatttataccccctatcaaaaaccgtgcgttttgaattaaagcccattggtaagacattagaacatatccacgccaaaaactttttgagccaagatgagaccatggcggacatgtaccaaaaggtaaaggcgatactggacgattatcatcgtgattttatcaccaagatgatgagcgaggtgacattaactaaactgccagagttttatgaggtttatttggcattacgaaaaaatcccaaagatgacacattgcaaaaacagctaaccgagatacaaaccgctttacgagaagaggtagtcaagccgatagacagtggtggcaaatacaaggctggttatgaacgcttatttggggcaaagctctttaaagacggcaaagagcttggtgatttggcaaaatttgtcatcgcccaagagggcgagtcatcgcccaagcttccccaaattgcccattttgagaagtttagtacttactttacgggctttcatgataaccgcaaaaacatgtacagtagtgatgataagcataccgccattgcctatcgtctgattcatgaaaacttgccacgttttatcgataatctacaaatactggtaaccatcaaacaaaagcactcggtattgtatgaccagattgtaaatgagctaaatgccaacggtttggatgtgtcgctggcaagtcatctggacggctatcacaagcttttaacccaagagggtatcacggcttataataggataataggtgaagtgaatagttatacgaataagcataatcaaatttgccacaaatctgaacgtatcgccaaattacgccccctgcacaaacaaatcctaagcgacggcatgggcgtgtcatttttgccaagcaaatttgccgacgatagcgagatgtgccaagcggtcaatgaattttaccgccattatgcccatgtttttgccaaggtgcaaagcttatttgatagatttgatgactatcaaaaggacggcatttatgttgagcataaaaatttaaatgagctatctaagcaggcatttggcgattttgctttgttgggtcgggtgttagacggctattatgtggatgtggtgaatccagaatttaacgataaatttgccaaagccaaaaccgacaatgccaaagaaaaactgacaaaagaaaaagacaaattcatcaaaggcgtgcattccttggcaagtcttgaacaggcgatagagcattatattgctgggcatgatgatgagtctgtgcaggcgggcaagcttgggcagtatttcaaacatggcttggcgggggtggacaatccaatccaaaaaatacacaacagccacagcaccattaaggggtttttggagcgtgaacgcccagcaggcgagcgaacattgcccaaaatcaaatcagataaaagtcttgaaatgacacagttaagacaactaaaagaactgctagacaacgccctaaatgtggtgcattttgctaagttattaacgaccaaaaccacgctagataaccaagacggcaatttttatggtgagtttggggcattgtatgatgagcttgccaagattgccacgctttataacaaagtgcgtgattatctgtcccaaaagccatttagcaccgaaaaatacaaattaaactttggcaacccgacattattaaacggttgggatttgaataaagaaaaagataattttggggttatcttgcaaaaagacggttgttattatttggcgttattggataaagctcataaaaaagtatttgataatgctccaaatacaggcaaaagtgtttatcaaaaaatggtttataaattattgcctggccctaataaaatgctacccaaagtgttttttgccaagagtaatttggattattataatccttctgcagagctactggataaatatgcacaaggcacgcacaaaaaaggcgataattttaatctaaaagattgtcatgcgttgattgatttttttaaggcgagtattaacaaacatccagaatggcaacattttggttttgaattttcgctaaccagtagctatcaggatttaagtgatttttatagagaagttgaaccacaaggttatcaagtaaaatttgtggatattgatgccgattatattgatgagttggttgagcagggtcagttgtatttattccagatttataataaagatttctcgcccaaggctcatggtaaacctaatttacatactttgtattttaaggcgttatttagtgaggataatcttgccaatccaatttataaattaaatggcgaggcggagatattttatcgcaaggcatctttggatatgaatgaaaccaccattcatcgtgcaggcgaggtattagaaaataaaaatcccgataatcccaaagagcgtcaatttgtctatgacatcatcaaagacaaacgttatacccaagataagtttatgctacacgtgcctattaccatgaattttggtgtgcagggcatgacgattaaagaatttaataaaaaagttaatcaaagcatacaacaatatgatgaggtgaatgtgattggcatagaccgtggcgagcgacatctgctatatctgaccgtgattaacagcaaaggtgaaatcttagaacagcgtagtctcaatgacatcatcaccacatcggcaaacggcacacaaatgaccacgccttatcataagatactggacaaaagggagatagaacgcctaaatgctcgtgtcggttggggtgaaattgagaccattaaagagctaaaatcgggctatctaagccatgtggtacatcaaatcagtcagcttatgcttaaatataacgccattgtggtgttggaagatttgaattttgggtttaagcgtggtcgctttaaggtggaaaaacaaatttaccaaaactttgaaaacgccctaatcaaaaaactcaaccatttggtattaaaagacaaggcagataatgagattggctcatacaaaaatgccttgcaactgaccaataattttaccgacctaaaaagcattggcaagcaaacaggctttttattctatgtgcctgcatggaataccagtaaaatagaccctgtaacgggctttgtggatttgttaaaaccacgttatgaaaatatcgctcaatcgcaagcgttttttgataagtttgataagatttgttataacgcagacaagggttattttgaatttcatattgattatgccaaattcactgacaaagccaaaaattctcgccaaatatggacgatttgttcgcatggcgataaacgctatgtgtatgacaaaaccgccaaccaaaataaaggggcgaccattggcattaatgtcaatgatgaattaaaatcgttatttgctcgttatcgcatcaatgacaaacagccaaatctggtcatggatatttgccaaaataacgataaagaatttcataaatcgctaacgtatctgttaaaggcattgcttgcattacgatatagtaatgccagtagtgatgaagattttattttatcgcctgtggcaaatgacaagggtgtgttttttaattcggcgttggcagatgatacacagccacaaaatgcggacgccaatggtgcgtaccatatcgcattaaaggggctgtggctattaaacgaattaaaaaacagcgatgatttggataaagtcaaacttgccattgataatcaaacatggctaaacttcgctcaaaaccgctaa

SEQ ID NO: 64 - DNA, 3756 bp, Artificial Sequence
  Description of Artificial Sequence: Synthetic polynucleotide
atgttgttccaggacttcactcatctttacccattatcaaaaacggtgcgctttgaactgaagcctattggtaaaacacttgaacacattcacgcaaagaattttctttctcaagacgaaaccatggctgatatgtatcagaaggtaaaggccatcttagatgattaccatcgcgatttcatcacgaaaatgatgagcgaggttaccttgaccaagttacccgaattttatgaggtgtaccttgccttgcgcaagaaccctaaagacgatactttacagaaacagcttacggaaattcagactgcattgcgcgaggaggtggttaaaccgatcgatagcggagggaagtacaaggccggttacgaacgtcttttcggggcgaaattatttaaggatggaaaagaactgggagatttggcaaaattcgtgattgcacaggaaggggaatccagcccaaagctgcctcagatcgctcatttcgagaagttctctacgtatttcacaggattccacgacaaccgtaaaaatatgtattcgagtgatgataagcacacggccattgcctaccgtttaatccacgagaatttaccccgctttattgacaatttacaaatcttggtgacgattaagcaaaaacactctgttttgtatgatcagatcgtaaacgaattgaacgcgaatggtttggacgtaagcttagcgagccaccttgatggataccataaattattaacacaagaaggcattacggcctacaatcgcattattggagaggttaattcctacactaacaagcacaatcagatctgtcacaaatctgagcgtatcgctaagcttcgccccttgcacaaacagattttaagcgacgggatgggcgtctctttcttaccttccaagtttgctgacgattctgagatgtgtcaggcagttaacgagttctaccgccattacgcccatgtctttgctaaggtacagagtttattcgaccgcttcgatgattaccaaaaggatggcatctacgtggaacacaaaaacttaaacgagttgtctaaacaagcatttggagattttgccttactggggcgcgttctggacggttactatgttgatgtcgtcaatcctgaatttaacgataaattcgcgaaggcgaaaacagacaacgcgaaggaaaagctgacaaaggaaaaagataagtttattaagggtgttcactcccttgcgtcgttggagcaagcaatcgaacactatatcgcgggccatgacgacgaatccgtgcaagctggcaaattaggccaatattttaaacacggcttggcgggcgttgataaccctatccagaaaattcacaatagccactcaaccattaagggcttcttagaacgtgaacgtcctgccggcgagcgtaccctgccgaaaattaagtctgataaatccttagagatgacgcagttacgccagctgaaggagttgcttgacaacgctctgaacgttgtgcactttgcaaaattacttactactaagactacgcttgataaccaggatggaaatttctatggcgaatttggagctttatatgatgaattagcaaaaattgcgaccctgtataacaaagttcgtgattacttgagtcaaaaaccattttctaccgagaagtacaaattgaactttggaaatccaacgttattaaatgggtgggatctgaacaaagagaaggataatttcggagttattcttcagaaggatggatgctattacctggcgttacttgataaggcgcacaaaaaggtgttcgacaacgctcctaacactggaaaatcggtttatcagaagatggtctacaagttacttccgggaccgaataaaatgctgccgaaagttttttttgcaaagtctaaccttgactattacaatccatccgcagagcttttagataaatacgcccagggcacccacaaaaagggtgacaattttaatttaaaggactgccacgcacttatcgactttttcaaggcttcaatcaacaagcatccagagtggcagcactttggcttcgagttctctttgacatcttcgtatcaggatctttctgatttctatcgtgaagttgaaccacagggttatcaggttaaattcgttgacattgacgccgactacatcgatgagctggtggagcagggtcagttatacctgttccaaatctataataaagatttcagtccgaaagcacatggtaagcccaatcttcatacgctttatttcaaggctctgttttcagaagacaaccttgcaaacccaatttacaaattgaacggtgaagcggagattttttaccgtaaagccagtttagatatgaacgaaaccacaattcaccgcgcaggtgaagtgttagagaataagaatcctgataacccgaaggaacgccagttcgtctatgacattatcaaagacaagcgctatacccaggacaaatttatgttgcacgtgccaatcaccatgaatttcggcgtgcaggggatgactattaaagaattcaacaagaaggtcaaccagagtatccaacaatatgacgaagtgaacgttattggcattgatcgcggcgagcgccaccttttgtacctgacggtaattaattcgaagggagaaattctggaacaacgttctctgaacgatatcattacaacatcggcgaatgggacgcagatgacgaccccttaccacaagattcttgataaacgtgaaattgaacgccttaacgcccgtgttggatggggtgagattgaaaccattaaggaattgaaaagtgggtacctgtcccatgttgtacaccagatcagccaattgatgttgaaatataacgcaattgtagtgttagaggatttaaacttcgggtttaagcgtgggcgtttcaaggtagaaaagcaaatttaccagaactttgagaatgctttaattaagaaacttaatcacttggttttgaaggacaaggccgacaacgagatcgggtcctacaaaaacgcgttgcaattaaccaataactttacggacttgaaaagtattgggaagcagaccggctttttattctacgtgccagcttggaacacatccaagattgatccggttacgggttttgtagacctgttaaaacctcgctatgaaaatattgctcaatcccaagctttcttcgacaagttcgataaaatctgctacaatgcagataaagggtattttgagtttcatatcgattatgccaaattcacagataaagctaaaaatagtcgccaaatctggacaatctgtagtcatggggacaagcgttacgtatacgacaagactgcaaaccagaataaaggtgccacaattgggatcaacgtgaatgacgagcttaaatccttatttgcacgttaccgcatcaatgataagcaaccaaatctggtcatggatatttgtcaaaacaacgacaaagagttccataaatctttgacctacttgcttaaagccctgttggccttgcgctatagcaacgcgtcaagcgatgaggatttcatccttagtccagtggccaacgataagggagtctttttcaatagcgctcttgctgatgatactcaacctcagaatgccgacgcgaacggagcgtaccatattgcacttaaaggcctgtggcttttgaatgaattgaaaaactcagatgatctggataaggtaaaattggcaattgacaatcaaacatggctgaactttgctcaaaaccgctaa

SEQ ID NO: 65 - DNA, 3756 bp, Artificial Sequence
  Description of Artificial Sequence: Synthetic polynucleotide
atgcttttccaagattttactcatttatacccgttaagcaaaacggtacgtttcgaacttaaacctatcgggaaaacgcttgaacacatccatgccaagaacttcctgagtcaggatgaaacgatggcggacatgtaccaaaaggtaaaggccattttagatgactatcatcgtgattttattaccaagatgatgtctgaggtaactttaacgaaattaccggaattttatgaggtctatcttgccttacgtaaaaacccgaaagatgacacattgcaaaaacagttaacggagatccaaaccgctctgcgtgaagaagtcgtgaagcccattgattcgggaggtaagtacaaggcgggatacgaacgccttttcggagccaaactgtttaaggacgggaaagaacttggcgacttggccaaattcgttatcgcacaagaaggcgaaagctctccaaaattaccccaaattgcccatttcgagaaatttagtacctactttacgggttttcacgacaaccgtaaaaatatgtacagctctgatgataaacacacggcgattgcatatcgtttgatccacgagaatcttccccgtttcattgacaaccttcaaattctggtgacaattaaacaaaagcattcggtcttatatgatcagatcgttaatgaattaaatgctaatggacttgatgtatcgttagctagccatttagatggttatcataaattgcttacgcaggagggaattactgcatacaatcgtatcattggggaagtgaatagttacaccaataaacataaccagatttgtcacaaaagtgagcgtattgcgaaactgcgtccgcttcataaacaaattttgagtgatggcatgggggtgtctttcttaccgagtaagtttgctgatgacagtgagatgtgccaagctgtcaacgagttttaccgtcactatgctcatgtgtttgcaaaagtacagtcccttttcgatcgcttcgatgactatcaaaaggatgggatctacgtggaacacaagaacttgaatgagttaagcaaacaggccttcggagattttgcactgttggggcgcgttttagacggatactatgtagacgttgttaaccctgagtttaatgataagttcgcgaaagcaaaaacggacaacgccaaagaaaaattgactaaggaaaaggacaaatttattaagggagtacattctcttgcgtccttggaacaagcgatcgaacattacatcgcgggccatgatgacgagagtgtccaagctggtaaacttggacagtattttaaacacggtctggccggtgttgataatccgatccagaaaattcataattcgcactcgaccattaaaggatttcttgaacgtgagcgtcccgctggcgagcgcaccttgcctaagatcaagtctgataagtctcttgaaatgactcaattgcgtcaactgaaagaacttctggacaacgcgttgaacgtcgtacatttcgccaagctgttgaccacgaagactacgcttgataatcaggacgggaacttctatggcgagttcggagctctgtacgatgagttggcgaaaatcgcgactttatataataaagttcgtgattatttgtcccaaaagccgtttagtacggaaaagtacaagctgaatttcggcaatcccactcttctgaacggctgggatttaaacaaagaaaaagacaacttcggggttatcttacaaaaggatggctgctattacctggcattacttgataaggcacataaaaaagtatttgacaacgcaccaaacaccggcaaaagcgtgtaccagaaaatggtatataaattgcttcccggtcctaacaagatgttaccgaaggttttttttgcaaaatccaatctggactattacaatccgagcgcagagcttctggacaagtacgcccagggtacgcataaaaaaggcgataatttcaacttgaaggactgtcatgcgctgatcgacttttttaaggctagtattaataaacaccccgagtggcaacattttgggtttgaattcagtctgacaagttcttaccaagacttgtcggacttttatcgtgaagtagagccacaaggttaccaagtaaaattcgtggacatcgatgctgactacatcgatgaacttgtcgagcaggggcagttgtatctttttcaaatttataataaagattttagtcccaaagcgcatggaaagccaaacttgcatacattgtactttaaagcattattttcggaagacaacctggccaatcctatctacaaattaaacggagaagcggaaattttttaccgcaaggcatctttggacatgaacgaaacaacgatccatcgtgctggggaggtccttgagaacaaaaaccccgacaaccccaaagaacgtcaattcgtttacgatatcatcaaagacaagcgttatacccaagataagtttatgttgcatgttccaattacgatgaattttggggtacaggggatgacaatcaaggaatttaacaagaaagtgaatcaatcaatccaacagtatgatgaagtgaacgtcattggtattgaccgcggagaacgccatctgttataccttactgtcattaactcaaagggagaaattttagagcaacgtagcttgaacgatatcattacgacgtccgcgaacggaacccaaatgaccacaccatatcacaagattttagataaacgtgagatcgaacgtcttaatgctcgcgtcgggtggggagagattgaaacgatcaaagagttaaaatctggatatttatctcatgttgtacaccagatcagccaattgatgttaaaatataatgctatcgtggttctggaagatctgaactttgggtttaagcgtggacgttttaaggttgaaaaacaaatctaccaaaacttcgagaatgcactgattaaaaagttgaaccacttagtgttaaaggataaggccgacaacgaaattggctcttacaagaatgcgcttcagctgacgaataatttcaccgatttgaaatcaatcggcaaacagaccggattcctgttctacgtcccggcttggaacacgtccaagatcgatcctgtgactggttttgttgacttattgaaaccccgctatgaaaacatcgcgcaatctcaagcgttctttgataagttcgataaaatctgctataatgcagacaaaggatatttcgagttccatattgattatgcaaaatttactgataaagcgaagaacagccgccagatctggacaatttgctcacacggtgataaacgttatgtttacgacaaaaccgctaatcaaaataaaggagccacaatcggcattaacgttaacgacgagttgaagtccctttttgcacgttatcgcattaacgacaaacagccaaatcttgtcatggatatttgtcaaaataatgacaaagaatttcataagagccttacgtaccttttgaaagctttattagcattacgctatagtaatgcctcatctgatgaggatttcattcttagcccggttgctaacgataaaggggtttttttcaatagtgctctggcagacgacacacaacctcaaaacgctgatgctaatggagcttatcacattgcgttgaagggactttggctgttaaatgaattgaaaaattctgacgacttggataaggtgaagttagcaattgacaaccaaacgtggttaaactttgcgcagaatcgttaa

SEQ ID NO: 66 - DNA, 3756 bp, Artificial Sequence
  Description of Artificial Sequence: Synthetic polynucleotide
atgctttttcaggatttcactcatttatacccattgagtaaaacagtccgtttcgagttgaaacccattggtaaaactcttgagcacattcacgctaagaatttcttatctcaagacgagaccatggccgatatgtaccaaaaagtaaaggctatcttagacgactatcaccgcgactttatcacaaagatgatgtctgaggtaactttgacaaagttacccgaattttacgaagtgtatcttgccctgcgtaaaaacccaaaagatgatactttgcaaaaacagttaacagaaatccaaaccgcattgcgcgaagaagtggtcaaaccgatcgacagcggtggtaaatacaaagctggttatgagcgtttgtttggtgctaaactttttaaggatggcaaggaactgggagaccttgcgaagttcgtaattgcccaagaaggagagagtagtccaaaattgcctcaaatcgcgcacttcgaaaaattctcgacgtattttactggctttcacgacaaccgtaaaaacatgtactcgtcggacgataaacatacggctattgcatatcgtttaatccatgaaaatttgccgcgtttcatcgataatttacaaatccttgttactattaaacaaaagcacagtgtactgtacgaccaaattgtgaatgaattaaatgcgaatggtcttgacgtttcgttagcctcccaccttgatggttaccacaagttgctgacccaggagggtattacagcatataatcgcatcattggtgaggtaaattcgtatactaacaagcacaatcaaatctgccataaatcagaacgtattgccaaattacgccctctgcataaacagatcttaagcgatggtatgggcgtcagttttttgccgtcgaaatttgcagatgacagcgagatgtgtcaagcggttaacgaattctaccgccactacgcccatgtatttgcaaaagtgcaaagccttttcgaccgctttgatgattaccaaaaagatggcatttacgtagagcacaaaaacttaaatgagttatcaaagcaagcttttggtgattttgcattgttgggtcgcgtccttgatggctattacgtggacgtcgtcaatcctgagtttaatgataagtttgcaaaagcaaagactgacaacgcaaaggaaaaacttactaaggagaaggataagtttattaaaggggtacattctttagcatcattggaacaggcgatcgaacattatatcgcgggtcatgacgatgagagtgtccaagctggcaagctggggcaatacttcaagcacggcctggctggcgtagacaacccaattcagaaaattcacaacagccatagtactattaaaggctttttggaacgtgagcgtcctgcgggagaacgcacattaccgaagattaaatcagataaatcattggagatgactcagttacgccaactgaaagaattgttggacaatgcattgaacgtggtccattttgcgaaattattaacgactaagacgacgctggacaatcaagatggtaatttttatggtgaatttggagcactgtacgatgagttggccaaaattgcaacactgtataataaagtacgcgactacttgtcccagaagcccttttcaacggagaagtacaaactgaactttggtaaccctaccttgttaaacggctgggatttgaataaggagaaggacaatttcggtgtcatcctgcagaaagatggatgctactatctggcgcttctggacaaagctcataaaaaggtcttcgacaatgctccgaatactggaaagtcggtgtaccaaaaaatggtttacaaacttctgcccggtcccaataagatgttgcccaaggtatttttcgctaagtccaatttggattactacaatccctctgcggaattattagacaaatacgctcagggcacacacaaaaagggggacaacttcaatcttaaggattgccacgcattaatcgactttttcaaagcgtcgatcaataaacatccagagtggcaacactttggattcgaattcagcttgacgtcaagttaccaagacctttccgacttctatcgtgaagtcgaaccccaaggttaccaagttaagttcgtggatattgatgcggactacattgacgagctggtggaacaaggccagctttatttgttccaaatctacaataaagacttcagcccgaaagcgcatgggaagccaaatcttcacacattatactttaaggctcttttttcggaggacaacttggctaatcccatttataaattaaatggtgaggctgaaatcttctaccgcaaggccagtttggatatgaacgaaacgaccatccaccgtgccggggaggtattagaaaacaaaaacccggataacccgaaagagcgtcagttcgtttatgatatcatcaaagacaagcgttacactcaagataaattcatgctgcacgttcctattacgatgaactttggcgttcagggcatgactattaaagaattcaataagaaggtgaaccagtctattcaacagtacgacgaggtaaatgttatcggtatcgaccgcggggaacgccatcttttataccttaccgttattaattccaagggggaaatccttgagcaacgtagtcttaacgatatcattactacgtccgcgaatgggacgcaaatgacgacaccatatcataagatcctggacaagcgtgagatcgaacgtttaaatgctcgcgtgggttggggcgaaattgaaacgattaaagagctgaaaagcggttacctttcgcacgttgtgcatcaaatctcacaattaatgttaaaatacaatgctattgtcgttttagaggatcttaactttggtttcaagcgtggtcgttttaaagtagaaaagcaaatttatcaaaacttcgagaatgcgcttattaagaaattaaaccacctggtcctgaaggataaagcggacaatgagatcggcagttacaaaaacgcattgcagctgacgaataatttcacagatctgaaatcaattggaaagcagaccgggtttttgttttacgttccggcatggaacacctcgaaaattgaccccgtaacggggtttgttgatttgttaaagccccgctacgaaaatattgctcagtcacaagctttttttgacaaatttgacaaaatctgttacaacgctgacaaaggttatttcgaattccacatcgattatgcgaaatttacggataaagcgaaaaattcgcgtcagatctggacaatctgttcgcatggtgataagcgctatgtatatgacaaaacagcaaaccagaacaagggagctacaattgggattaatgttaacgacgagctgaagtcactttttgcgcgctaccgtattaacgataagcaaccgaaccttgttatggacatctgccaaaacaatgacaaagaattccacaagtcattgacgtacctgttgaaagctttactggcactgcgttattccaacgcttcctcggacgaagatttcattttgtcgcctgtagcgaatgacaaaggcgtgttctttaactctgctttggcagatgatacacaacctcaaaatgcggacgccaacggtgcctaccatatcgcgctgaagggtttgtggttattaaatgagcttaaaaacagtgatgatttggataaggtaaagttagccatcgataatcagacttggttgaattttgctcaaaaccgttaa

SEQ ID NO: 67 - DNA, 3756 bp, Moraxella lacunata
atgttatttcaagactttactcatttataccccctatcaaaaaccgtgcgttttgaattaaagcccattggtaagacattagaacatatccacgccaaaaactttttgagccaagatgagaccatggcggacatgtaccaaaaggtaaaggcgatactggacgattatcatcgtgattttatcaccaagatgatgagcgaggtgacattaactaaactgccagagttttatgaggtttatttggcattacgaaaaaatcccaaagatgacacattgcaaaaacagctaaccgagatacaaaccgctttacgagaagaggtagtcaagccgatagacagtggtggcaaatacaaggctggttatgaacgcttatttggggcaaagctctttaaagacggcaaagagcttggtgatttggcaaaatttgtcatcgcccaagagggcgagtcatcgcccaagcttccccaaattgcccattttgagaagtttagtacttactttacgggctttcatgataaccgcaaaaacatgtacagtagtgatgataagcataccgccattgcctatcgtctgattcatgaaaacttgccacgttttatcgataatctacaaatactggtaaccatcaaacaaaagcactcggtattgtatgaccagattgtaaatgagctaaatgccaacggtttggatgtgtcgctggcaagtcatctggacggctatcacaagcttttaacccaagagggtatcacggcttataataggataataggtgaagtgaatagttatacgaataagcataatcaaatttgccacaaatctgaacgtatcgccaaattacgccccctgcacaaacaaatcctaagcgacggcatgggcgtgtcatttttgccaagcaaatttgccgacgatagcgagatgtgccaagcggtcaatgaattttaccgccattatgcccatgtttttgccaaggtgcaaagcttatttgatagatttgatgactatcaaaaggacggcatttatgttgagcataaaaatttaaatgagctatctaagcaggcatttggcgattttgctttgttgggtcgggtgttagacggctattatgtggatgtggtgaatccagaatttaacgataaatttgccaaagccaaaaccgacaatgccaaagaaaaactgacaaaagaaaaagacaaattcatcaaaggcgtgcattccttggcaagtcttgaacaggcgatagagcattatattgctgggcatgatgatgagtctgtgcaggcgggcaagcttgggcagtatttcaaacatggcttggcgggggtggacaatccaatccaaaaaatacacaacagccacagcaccattaaggggtttttggagcgtgaacgcccagcaggcgagcgaacattgcccaaaatcaaatcagataaaagtcttgaaatgacacagttaagacaactaaaagaactgctagacaacgccctaaatgtggtgcattttgctaagttattaacgaccaaaaccacgctagataaccaagacggcaatttttatggtgagtttggggcattatatgatgagcttgccaagattgccacgctttataacaaagtgcgtgattatctgtcccaaaagccatttagcaccgaaaaatacaaattaaactttggcaacccgacattattaaacggttgggatttgaataaagaaaaagataattttggggttatcttgcaaaaagacggttgttattatttggcgttattggataaagctcataaaaaagtatttgataatgctccaaatacaggcaaaagtgtttatcaaaaaatggtttataaattattgcctggctctaataaaatgctacccaaagtgttttttgccaagagtaatttggattattataacccttctgcagagctactggataaatatgcacaaggcacgcacaaaaaaggcgataattttaatctaaaagattgtcatgcgttgattgatttttttaaggcgagtattaacaaacatccagaatggcaacattttggttttgaattttcgctaaccagtagctatcaggatttaagtgatttttatagagaagttgaaccacaaggttatcaagtaaaatttgtggatattgatgccgattatattgatgagttggttgagcagggtcagttgtatttattccagatttataataaagatttctcgcccaaggctcatggtaaacctaatttacatactttgtattttaaggcgttatttagtgaggataatcttgccaatccaatttataaattaaatggcgaggcggagatattttatcgcaaggcatctttggatatgaatgaaaccaccattcatcgtgcaggcgaggtattagaaaataaaaatcccgataatcccaaagagcgtcaatttgtctatgacatcatcaaagacaaacgttatacccaagataagtttatgctacacgtgcctattaccatgaattttggtgtgcagggtatgacgattaaagaatttaataaaaaagttaatcaaagcatacaacaatatgatgaggtgaatgtgattggcatagaccgtggcgagcgacatctgctatatctgaccgtgattaacagcaaaggtgaaatcttagaacagcgtagtctcaatgacatcatcaccacatcggcaaacggcacacaaatgaccacgccttatcataagatactggacaaaagggagatagaacgcctaaatgctcgtgtcggttggggtgaaattgagaccattaaagagctaaaatcgggctatctaagccatgtggtacatcaaatcagtcagcttatgcttaaatataacgccattgtggtgttggaagatttgaattttgggtttaagcgtggtcgctttaaggtggaaaaacaaatttaccaaaactttgaaaacgccctaatcaaaaaactcaaccatttggtattaaaagacaaggcagataatgagattggctcatacaaaaatgccttgcaactgaccaataattttaccgacctaaaaagcattggcaagcaaacaggctttttattctatgtgcctgcatggaataccagtaaaatagaccctgtaacgggctttgtggatttgttaaaaccacgttatgaaaatatcgctcaatcgcaagcgttttttgataagtttgataagatttgttataacgcagacaagggttattttgaatttcatattgattatgccaaattcactgacaaagccaaaaattctcgccaaatatggacgatttgttcgcatggcgataaacgctatgtgtatgacaaaaccgccaaccaaaataaaggggcgaccattggcattaatgtcaatgatgaattaaaatcgttatttgctcgttatcgcatcaatgacaaacagccaaatctggtcatggatatttgccaaaataacgataaagaatttcataaatcgctaacgtatctgttaaaggcattgcttgcattacgatatagtaatgccagtagtgatgaagattttattttatcgcctgtggcaaatgacaagggtgtgttttttaattcggcattggcagatgatacacagccacaaaatgcggacgccaatggtgcgtaccatatcgcattaaaggggctgtggctattaaacgaattaaaaaacagcgatgatttggataaagtcaaacttgccattgataatcaaacatggctaaacttcgctcaaaaccgctaa

SEQ ID NO: 68 - DNA, 3756 bp, Artificial Sequence
  Description of Artificial Sequence: Synthetic polynucleotide
atgttattccaagatttcacacatctttatccactgtcgaagacagtccgctttgagttaaagcctattggaaagacccttgaacacattcatgcgaagaatttcttatcacaagacgaaacaatggcagatatgtatcaaaaagtgaaagctatcttagacgactatcatcgcgattttatcacgaagatgatgagtgaagtcaccttgaccaagttacctgagttttacgaggtttatctggccttacgcaagaatccaaaagacgacaccctgcaaaaacagttaaccgagattcaaacagccttacgtgaagaagttgtgaagcccattgattccggaggcaaatataaagcgggttacgagcgtttatttggggctaaactttttaaggacggaaaggaacttggcgacctggccaaatttgttattgcccaagaaggggaaagctcgccgaagcttccacagatcgctcattttgaaaaattttctacctacttcacgggttttcatgataaccgtaaaaacatgtatagctctgacgataagcacacagctatcgcttaccgccttattcacgagaaccttccgcgttttatcgacaatttgcaaatccttgtaaccatcaaacaaaaacactcagtcctgtatgaccaaattgtcaacgaacttaacgcgaatggcttggatgtttctctggcgtcccacttagatgggtaccacaagctgttgactcaggaaggcattacagcatataatcgtattatcggagaggttaattcgtacactaacaagcacaaccaaatctgtcacaaatctgaacgcatcgctaagctgcgtccattacacaagcaaatcctgtcggacggcatgggagtatcgttcctgccgtctaagttcgcggacgacagtgaaatgtgtcaagcagttaatgaattctatcgtcactacgctcacgtgttcgcgaaggttcaaagcttattcgaccgcttcgatgactatcaaaaggacggtatttatgtggagcacaaaaatctgaacgagctgtctaaacaggcgttcggcgattttgccctgctggggcgcgtattagacggttattatgtcgatgtagtcaatcctgagtttaacgataagtttgctaaggccaagaccgataacgcgaaagagaagttgacgaaagaaaaggacaaattcattaagggggtgcattctttggcttctttggagcaagcgattgagcattatatcgcgggccacgatgatgaatctgttcaggccggtaagctgggacagtacttcaaacatggactggcgggtgttgacaaccctattcaaaaaatccacaacagccacagcacaatcaaggggtttcttgaacgcgaacgtccagccggtgaacgtaccttacctaagatcaagtcggacaagagtttggagatgactcaattgcgtcagcttaaggagttgctggacaacgctctgaacgtcgtccatttcgcgaaattattaacaacgaagacgactttagataaccaggatggcaatttctatggagaattcggagctttgtatgacgaactggcaaaaatcgctacgctgtataataaagtgcgtgactatttgagccagaaaccctttagcactgaaaagtataaacttaacttcggaaatccgacactgttgaatggatgggatcttaacaaggaaaaggataattttggagtaatcttgcagaaagacggctgctattacttggctttgctggacaaagcccacaagaaggtatttgataatgcgccgaatacgggtaagagcgtctaccagaaaatggtatataagctgcttccgggcagcaacaaaatgttacccaaagtgtttttcgcaaagtccaaccttgattattataatccgagtgccgagctgttagacaaatatgcgcagggaactcacaagaaaggagacaatttcaatctgaaggactgtcatgccttaattgattttttcaaagctagcatcaataaacatcccgaatggcaacactttggtttcgagtttagcctgacttcgagttatcaagaccttagcgacttctatcgtgaagtggaacctcaagggtatcaagtcaaattcgtggacattgacgccgattatattgatgaactggttgagcaaggacagctttacctgttccagatctataataaggatttctcgccgaaggcacacggtaaacctaacttgcatactttgtactttaaagcgcttttcagtgaggacaatttagcaaacccaatctataagttaaatggcgaggcggaaattttctaccgtaaagcgtcattagacatgaatgaaacaacaatccatcgcgccggcgaagttttggagaacaagaaccctgataacccgaaagagcgccagttcgtttatgacattatcaaggataagcgctacactcaggataaatttatgttgcatgtacccatcacaatgaacttcggggtacagggaatgactatcaaggagtttaataaaaaagtcaatcagtcgatccagcagtatgatgaagtgaacgtaatcggaattgatcgcggagagcgccacttgctgtacctgaccgtaattaacagtaaaggagaaatcctggagcagcgcagcctgaatgacatcattacgacgagcgcgaatggaacccagatgacaacaccgtatcataagattctggacaagcgtgagatcgaacgtttaaacgctcgcgttggatggggggaaatcgagacaatcaaggagttgaaatccgggtaccttagccatgtggtacaccaaatctcgcaattaatgcttaaatacaacgctattgtagtgctggaagatctgaatttcggttttaaacgtggacgtttcaaggtcgaaaaacaaatttaccaaaatttcgaaaatgctcttattaaaaagcttaaccaccttgtccttaaagataaagcggataatgagattggctcatacaaaaatgccctgcagttgaccaacaacttcactgaccttaagagcattggaaaacagacagggtttcttttttacgtcccggcatggaacacgtcaaaaattgacccagtcacggggttcgtagacttactgaaaccacgctatgaaaatatcgcgcaaagtcaggcgttctttgataaatttgacaaaatctgctataatgctgataaaggttattttgagtttcatatcgactacgccaaattcacggataaggcgaagaatagccgccagatctggacgatttgcagccatggggataagcgttatgtatatgacaagacggccaatcagaataaaggcgccactattggcattaacgtcaacgacgagttaaagagcctttttgcacgctatcgtatcaacgataaacagccgaatctggttatggatatttgccagaacaatgataaagagtttcacaaatctcttacttacttattaaaagctcttttggctcttcgttactccaacgcatcctcggacgaagatttcatcctgtctccggtagctaacgataaaggcgtgttcttcaattccgctttagcggatgatactcagccgcagaacgcggatgcaaatggggcttatcacattgctttaaagggtttatggttattaaatgagttgaaaaactcagacgatcttgacaaagtaaagttggctattgacaatcaaacatggttaaactttgctcagaaccgctaa

SEQ ID NO: 69 - DNA, 3756 bp, Artificial Sequence
  Description of Artificial Sequence: Synthetic polynucleotide
atgctgttccaagactttactcacctttatccgctttctaaaaccgttcgcttcgaacttaaacctattggtaagacactggagcatatccacgccaaaaacttccttagccaggacgaaacaatggcagacatgtaccaaaaggtaaaggcaattttggatgattatcaccgcgatttcatcacaaagatgatgtctgaggtcacattaaccaaactgcccgaattttacgaggtgtacctggcccttcgcaaaaaccccaaggacgatacccttcaaaagcaacttacggagatccagacggcgctgcgcgaggaagtggtcaaaccgatcgactcggggggaaagtacaaggcgggttacgagcgtttgtttggtgcaaaattatttaaggatggcaaggaactgggtgacttagcaaaatttgtcatcgcccaggagggcgaaagctcccccaaattacctcagattgcccattttgagaagtttagcacctatttcacgggttttcatgataaccgcaaaaatatgtatagcagcgacgataagcatacggcgatcgcatatcgtcttatccatgaaaatttaccgcgtttcattgacaacttgcaaatcttagtcaccattaagcaaaaacatagcgtcttatacgaccaaattgtcaacgagttgaatgccaatgggttagacgtctccttagcgagtcaccttgatggataccataagttacttacccaagagggtatcactgcatataatcgtatcattggtgaagttaattcatacactaacaaacataatcagatctgccataagtcggagcgtatcgcaaaattacgcccattacataagcagattctgtccgacggcatgggggtctcctttcttccgtcgaagtttgctgacgacagtgaaatgtgccaggctgtcaatgaattctatcgccattatgctcatgtattcgctaaggttcaatcactgtttgatcgtttcgatgattatcagaaagatggaatctatgtggaacataagaacctgaacgaactttcaaaacaggcgttcggcgatttcgcacttcttggacgtgtccttgatggttactatgtggatgtcgtcaacccagagttcaatgacaaattcgcgaaggccaagacggataacgcaaaagaaaaacttacaaaggagaaagataaattcatcaaaggcgtgcactcccttgcgtcgctggaacaggcgattgaacactatattgcaggacatgatgatgagagcgtacaagcaggaaaattaggacaatattttaaacacggtttggcgggagtagataatccgatccaaaagatccacaatagccacagtactatcaaaggttttcttgaacgcgagcgccccgcaggagaacgtaccctgccaaagatcaagagcgataagtctttagaaatgacccaattacgccagctgaaagagttgttagataatgcattaaacgtagtacactttgctaagttgttgaccacgaagactacgttggacaatcaagacggtaacttctacggtgaattcggagctttatacgatgagcttgcaaagattgcaaccctgtataataaggtgcgcgactatttgtcccagaagcccttttccacggaaaaatataaactgaactttgggaacccgacattacttaatggatgggatttaaataaggaaaaagacaacttcggtgtgatcttgcaaaaggacggctgttattacctggccctgttggataaagcacataaaaaagtgttcgataatgcccctaatacggggaagtcagtctaccaaaaaatggtgtataaattattacctgggtccaacaagatgcttcctaaagtattctttgcgaaatcaaaccttgattattacaatccctcggcggagcttctggataagtacgcgcaaggcacacacaagaagggggacaacttcaacttaaaggactgtcatgcacttattgatttcttcaaagcttcaattaataaacacccggagtggcaacactttgggtttgaattctctcttacttcatcctaccaggatttgtccgatttttatcgtgaagttgagccacagggttatcaagttaagttcgttgacatcgatgccgactatatcgatgaattagttgaacaaggccaactgtatttatttcaaatttacaacaaagattttagcccaaaagctcacgggaagccaaatttgcataccttatatttcaaggcccttttcagtgaagataatctggcaaatcctatttataagttgaatggtgaggcggagatcttttaccgtaaggcttcgctggatatgaacgaaacaacgattcatcgtgcaggcgaagtgctggaaaataaaaacccagataacccgaaggagcgccagtttgtatacgatatcattaaggataaacgttacacgcaggacaaatttatgttgcatgtgccaatcaccatgaactttggtgtgcaggggatgacgatcaaggaattcaacaaaaaggtcaaccaaagcatccaacagtacgacgaggtaaatgtgattggtattgatcgtggagagcgccatttgttatatttaacggtcatcaactctaagggggagatcttggagcaacgctcactgaatgatattattacaacgagcgccaacggcactcaaatgacaactccataccacaaaatcttggataaacgcgagattgaacgtttgaacgcacgtgttggatggggagaaattgaaaccattaaagaattaaaatcgggttatcttagccatgtcgtacaccaaatttcccagttaatgctgaagtacaatgcaattgttgtcctggaagatttaaattttggatttaagcgcggccgtttcaaagtcgaaaaacaaatctaccagaacttcgaaaatgccctgatcaaaaaattgaaccaccttgtacttaaggacaaggcagataacgaaatcggcagttataagaatgcccttcaactgacaaataattttaccgacttaaaaagcattggtaaacaaacagggtttttgttctatgtacctgcatggaatacctccaaaattgatccagtaactgggttcgtagatctgttgaagcctcgttatgaaaacattgcccagtctcaggcatttttcgacaagttcgataagatctgctataacgcggataaaggttactttgaattccacattgattatgcaaaatttacggacaaggctaagaattctcgccagatttggaccatctgttcacatggtgataaacgttacgtctacgataagaccgctaatcaaaacaagggggcaacaatcggcattaacgttaatgatgagctgaaatctttatttgcccgctaccgtatcaatgacaaacaaccgaaccttgtcatggatatctgccaaaacaatgataaggaatttcacaaatcgctgacctatttattgaaggcgttgttagctttacgttattctaatgcgtccagtgacgaggactttattctgtctccagtcgctaacgataaaggggtctttttcaactcagctcttgccgatgatactcaaccacaaaatgctgacgcaaacggggcctatcatatcgcgctgaagggcctttggctgttaaacgaattaaagaacagtgacgatttggataaagtcaagttagcaattgacaatcagacttggttgaatttcgcgcaaaaccgctaa

SEQ ID NO: 70 - DNA, 3756 bp, Artificial Sequence
  Description of Artificial Sequence: Synthetic polynucleotide
atgctttttcaagatttcacccatctttatccacttagcaaaacggtacgcttcgagcttaaaccaatcggaaaaactttagaacacattcatgcaaaaaactttttatcccaagatgaaacgatggctgacatgtaccagaaagttaaggcaattttggatgattatcatcgcgacttcattactaagatgatgtcggaggtaacactgacaaaattgccagagttttacgaggtgtatttagctctgcgcaagaaccccaaggacgacaccttgcagaaacaattgacggaaatccagacagcgttacgcgaggaagttgtgaagcccatcgattcgggcggtaaatataaagcagggtatgagcgcctgttcggtgctaaacttttcaaggatggcaaggagctgggtgacttagccaagttcgtgatcgcccaagaaggcgaatcatcacccaagcttccgcagattgcccactttgaaaaattttctacctattttacgggatttcacgataaccgcaaaaatatgtattcttccgatgacaaacatactgctatcgcctaccgtcttattcatgaaaatttgcctcgtttcattgacaatttgcaaatccttgtaacaatcaaacagaaacatagtgtgttgtacgaccagattgtcaatgagctgaacgcaaacgggctggacgtgagcttagcaagccatctggatgggtaccacaagttgttaacccaagagggaatcaccgcatacaaccgcatcatcggtgaggtcaattcctatactaacaaacataatcaaatctgccacaaaagcgaacgtatcgcgaaacttcgccccttacacaagcaaatcttgagcgacggcatgggagtatccttccttccgagtaaatttgccgacgattctgagatgtgtcaagctgtaaatgaattctatcgtcactatgcacatgtctttgccaaagttcagagcttgtttgaccgtttcgacgattaccagaaagatggcatttacgtagagcataagaacttgaatgagctgagcaagcaagcctttggagacttcgctttattgggacgtgtgctggatggctattacgtggacgttgtaaacccagagttcaacgataagttcgcgaaagcgaagacagacaacgcaaaagaaaaattaacaaaggaaaaagacaaatttattaaaggggttcattctcttgcctccttggaacaagcaatcgaacattacattgcaggccacgacgatgagagcgttcaggcgggaaaattaggccaatactttaagcatgggcttgctggcgtcgataacccgattcaaaaaattcataactcccacagcacaattaaggggtttcttgagcgtgagcgccctgctggcgaacgcacactgcccaagatcaaatccgacaaatccttggagatgacacagctgcgccagttgaaggagttgttagataatgcgttaaatgtagtacattttgcaaagttactgactacgaaaacaacccttgacaaccaagatggcaatttttatggggagtttggtgccttatacgatgagcttgctaaaatcgccacattatataataaagtgcgcgattatcttagtcagaagcctttctccacagaaaagtacaagttaaactttggaaacccaacgttgctgaatgggtgggatttaaacaaggaaaaagataatttcggagttatcttacaaaaagatgggtgttattaccttgcattgctggacaaagcccataaaaaggtattcgacaatgcaccgaacacaggtaaatcggtctatcaaaagatggtgtataaacttcttcctggatcaaacaagatgctgccgaaagtattcttcgcgaagagtaaccttgactattataatccttcggccgaattacttgacaaatatgctcagggcacacacaaaaaaggtgataactttaatctgaaagattgtcatgctcttattgatttctttaaggctagcattaacaaacatcccgaatggcagcacttcgggtttgaatttagcttaacttcttcctaccaggatctttctgatttctaccgcgaggtggaacctcaaggttatcaagttaagttcgtagatatcgatgcagactacatcgacgaacttgtggaacaaggccaactgtatttatttcaaatctataataaggactttagtcccaaagcgcatgggaaaccgaatttgcacaccctttactttaaggcgctttttagtgaagacaatcttgcaaatcccatctataagcttaacggcgaagctgagatcttttaccgcaaagctagtttagatatgaacgaaactacaattcaccgtgcgggggaggtgctggaaaacaaaaatccggacaatcctaaagaacgtcagtttgtatatgacatcatcaaagataagcgttatacgcaggataagtttatgctgcatgtgcccatcactatgaactttggagtacaagggatgaccatcaaagagtttaataagaaagttaatcaatcgatccaacaatatgacgaggttaacgtgatcggaatcgatcgcggagagcgccacttattatacttaacggtcatcaactcgaaaggtgagattttagagcagcgttctttgaacgacatcattacgaccagcgcgaatggtacgcagatgacgacgccttaccataaaattcttgataaacgtgaaattgaacgtttaaatgctcgcgtaggttggggcgaaattgagacgattaaggaactgaagtccggatatctttcccatgtggttcatcaaatctcacagctgatgttgaaatacaatgccatcgttgttttagaagatttaaatttcggctttaaacgcgggcgctttaaagtggaaaagcaaatttaccaaaacttcgaaaacgcccttattaagaaacttaatcacttagtattgaaggacaaagccgataacgaaattggtagttacaagaacgccttacagcttactaataatttcaccgatttaaaaagcattgggaaacaaacaggctttttgttctacgtcccagcctggaacactagtaaaattgatcccgttacaggttttgtagacctgcttaagcctcgttatgaaaacattgctcaatctcaagcattcttcgacaagtttgataaaatctgctacaatgcggataaagggtacttcgagttccacatcgactatgcaaagtttaccgataaggcaaaaaattctcgtcagatctggacaatctgtagccatggggataaacgttatgtgtatgataagactgctaaccaaaataagggggctacaattggtattaacgttaacgatgaattgaaaagtctgtttgcccgttaccgtatcaacgataaacagccgaacttggttatggacatctgccaaaacaatgacaaagagtttcataagtccttgacttatcttcttaaggcattattagctctgcgttacagtaacgcttcgtctgacgaagactttattttatcaccggtggcgaatgacaagggcgtttttttcaattctgcgttagctgacgatacgcagccgcagaatgccgatgcaaatggtgcttatcatattgccctgaaagggttgtggttgttgaacgagttaaaaaactccgatgatttagacaaagttaaattagcgattgataatcaaacgtggctgaacttcgctcaaaaccgttaa

SEQ ID NO: 71 - DNA, 3774 bp, Unknown
  Description of Unknown: Sodaliphilus pleomorphus sequence
atgaagtataccgattttacaggcatttatcctgtgtctaagactttaagatttgagctcattccacaaggatctactgtggagaacatgaaacgcgagggcattctgaacaacgatatgcatcgtgccgatagctacaaggaaatgaaaaaattgattgatgagtaccacaaggtatttatcgagcggtgcttgtctgatttctccctgaagtatgacgatacgggaaaacacgattctcttgaggaatattttttctactacgagcaaaagagaaacgataagacaaaaaaaatctttgaggatatccaagtcgctttgcgtaagcaaatttcaaaaaggtttactggcgatactgcgtttaaaagacttttcaagaaagaactcatcaaagaagacttgcccagttttgtaaaaaacgacccagttaagactgaactgataaaggagttttctgatttcaccacctattttcaggaattccacaagaatcgcaaaaacatgtatacatctgatgcgaaatctactgctattgcctaccgcatcatcaacgaaaacttgcccaaattcatcgacaatatcaacgcatttcacattgttgccaaggtgcccgaaatgcaagagcattttaagacaatagccgatgagcttaggagccacttacaggttggagatgacatcgataagatgtttaacctgcaatttttcaacaaagtgctgactcagtcacaactcgctgtatataatgccgttataggaggcaagagcgagggaaacaagaaaatacaaggcatcaatgagtatgttaacctttataaccagcagcataaaaaggcgcgcttgccaatgctgaaactgctgtataagcagatcttgagcgatcgcgttgccatttcatggttacaggatgaatttgataatgaccaggacatgcttgatacaatagaagccttctataacaagcttgatagtaatgaaactggtgtgctgggcgaaggcaagctcaagcaaatactcatgggactggacggctacaatttggatggagtgttcctgcgcaacgatttgcagctctccgaagtttctcagcgcctgtgcggtggctggaatataataaaggatgccatgataagtgacttgaaacgtagtgtacagaagaagaaaaaagaaactggtgccgattttgaagagcgtgtatcaaaacttttctctgcccagaacagtttctcaattgcttatatcaaccagtgccttgggcaggcaggaataaggtgtaagattcaagattactttgcttgtcttggtgcaaaagagggtgaaaacgaagcagagacgactcccgacattttcgatcaaattgctgaggcttaccatggggccgctccaatattaaatgctcggccaagcagtcataatttggctcaggatattgagaaggttaaagcaatcaaagccttgcttgatgcgctcaagcgcttgcagcgatttgtcaagccattgcttggtcgtggcgatgagggcgataaggatagtttcttctatggcgattttatgccgatatgggaagttctcgaccagctcactccgctgtacaacaaggttcgaaaccgaatgactcgtaaaccctattcgcaagaaaaaatcaaacttaatttcgagaatagtacgctgttgaatggctgggacttgaacaaagagcatgataacacaagcgtgattttgcgccgcgaagggttgtactacttaggcatcatgaataaaaactataataaaatatttgatgccaacaatgttgaaaccataggagactgttacgaaaaaatgatttataaacttttgccgggtcccaacaagatgcttcctaaggtgttcttctccaaatcaagagtgcaggaattctctccgagcaagaaaattcttgaaatttgggagagtaagtcttttaagaaaggtgataatttcaatctcgacgattgtcatgctctcatagatttctataaagattctatagcaaagcatcccgactggaataaatttaacttcaagttctctgatactcagtcatatacaaatattagtgatttttatcgtgatgttaatcagcagggttactccctttctttcacaaaagtgagtgttgactatgtcaacaggatggtggacgaaggcaagctatatcttttccaaatctacaataaggacttttcaccccaaagcaagggtacacccaacatgcacaccctatactggcgcatgctctttgatgagcgcaacttgcacaatgttatttataagctcaatggtgaagccgaagtgttttaccgcaaggcaagcctaaggtgcgatcgacctactcaccccgcacatcagcctattacttgcaaaaacgaaaatgactccaaacgtgtgtgtgtgttcgactacgacattattaaaaatcgccgatacaccgttgataaattcatgtttcatgttcctataacaataaattataagtgtactggcagcgacaacatcaatcagcaggtgtgtgattatttgcgctcggcaggcgatgacactcacatcataggcatcgaccgtggagagcgcaatttgctctacttggtgataatcgaccagcatggtactattaaggagcaattttcgcttaacgagattgtcaacgagtacaagggtaatacctattgcaccaattatcataccttacttgaggagaaggaagctggcaacaagaaagcccggcaagactggcaaactattgaaagcataaaagaactcaaagagggctatctgtcgcaggtaatccacaagatctctatgctcatgcagcgttatcatgccattgttgtacttgaagatttgaacggttcgttcatgcgtagcaggcaaaaagtggaaaagcaggtatatcagaaatttgagcacatgctcatcaacaagcttaactacttagtcaacaagcaatatgatgctgccgagccaggaggcttgttgcacgcattgcaactcacgagcagaatggatagttttaaaaagctgggcaagcaaagcggtttccttttctatattccagcatggaatacttcaaagattgatcctgtgactggatttgtcaacctttttgacactcgttactgcaatgaagccaaagctaaggagttctttgaaaaatttgacgacataagctacaatgacgagcgtgattggtttgagttttcttttgattatcgtcattttaccaacaagcctactggaactcgtactcaatggacactatgcacccaagggacacgtgtacgcacttttcgcaatcccgagaaaagcaatcattgggacaatgaggaattcgatctcacacaagcatttaaagacctctttaacaaatatggcatcgatatcgcttcgggacttaaagcccgtatagttaacgggcagctcactaaagaaacctctgcagtcaaagacttctatgagtcgttgcttaagttactaaaactcactttgcagatgcgaaatagtgtcactggtactgacattgattatcttgtatcccctgtggctgataaagatggtatttttttcgacagccgaacttgcggtagccttttacctgccaatgccgacgccaatggagctttcaatatagcacgaaaaggattgatgttgttacgtcagattcaacaaagctcaattgatgcagaaaagatccagctcgctcccattaaaaatgaagattggcttgaattcgctcaggagaaaccatacttgtaa

SEQ ID NO: 72 - DNA, 3774 bp, Artificial Sequence
  Description of Artificial Sequence: Synthetic polynucleotide
atgaaatacacggacttcacgggtatctacccagtgtcgaagacactgcgctttgaattgattccccaaggctccactgtagaaaatatgaagcgtgagggaattctgaataacgatatgcatcgcgcagacagctacaaagagatgaagaagcttattgatgaatatcataaagtctttatcgagcgctgtttaagcgatttcagccttaaatatgatgacaccgggaaacacgattcattggaagagtattttttctactacgaacagaagcgtaatgacaagacgaagaagatctttgaagacatccaagtcgcattgcgcaaacagatcagtaaacgcttcacaggcgatactgcttttaagcgcctttttaagaaggaacttatcaaagaagatctgccgtcctttgtaaaaaacgatccggttaagacggaattgattaaagagtttagtgatttcactacgtatttccaagaatttcataagaaccgcaagaacatgtatacttcagatgctaaatctacggcaatcgcctaccgtattattaatgagaatcttcctaagttcatcgacaatattaacgcttttcacattgtagcaaaggttcctgaaatgcaagaacattttaagacgattgcggatgagctgcgttctcaccttcaagtgggtgacgacattgacaaaatgttcaatttacaattttttaataaggttcttacacaatcacaacttgccgtgtacaacgccgtaatcggcggtaagtctgagggcaataagaaaatccagggcattaacgaatacgtaaatctgtataaccaacagcataagaaggcccgtcttcctatgcttaaactgttatacaagcagatcttgagcgaccgcgtggcaatttcatggctgcaggatgaatttgataacgatcaggacatgcttgacacaatcgaggccttttataataagctggatagtaacgaaacgggagttctgggagaaggtaagttaaagcagattttgatggggctggacgggtataatcttgatggggtcttcttacgcaacgacctgcagttgagcgaggtgtcccaacgcctgtgcggaggctggaacatcattaaggacgcgatgatttcggacctgaaacgcagtgtacagaaaaaaaagaaggaaactggagcggactttgaggaacgcgtctccaaactttttagtgctcaaaatagtttttcgatcgcttatatcaaccagtgcctggggcaggcgggaattcgctgtaagatccaagattattttgcgtgcttgggggcaaaggagggggagaatgaagctgagactactccagatatttttgaccagattgcagaggcttatcatggggcggcaccaattcttaatgcccgccctagctctcataacctggcgcaggacatcgagaaggtgaaagcaatcaaagctctgcttgacgcactgaaacgcctgcaacgctttgtgaagcccttattaggccgcggagacgaaggcgataaagatagcttcttctacggggacttcatgccgatctgggaggtacttgatcagttaacccccttatataataaggtgcgtaaccgtatgacgcgtaaaccatactcgcaggaaaagattaaattaaactttgagaactctactttactgaacgggtgggacctgaataaagaacacgacaatacatcagtgatcttacgccgtgagggactttattatctgggcatcatgaacaagaattataacaagattttcgacgcgaacaatgtcgaaacaattggcgattgctacgagaaaatgatctataagttgttaccgggtccaaataaaatgcttcctaaagtgttctttagcaaatcgcgcgtgcaggaattctcgccaagcaagaagatcttagaaatctgggaatcgaaatcctttaaaaaaggagataactttaaccttgatgactgccacgcccttattgacttctacaaagattcaattgctaagcaccctgactggaataagtttaactttaagttttccgacacccagtcatacactaacatttctgacttctatcgcgacgttaatcaacaaggctacagtctttcattcacgaaggtgtcggtggattacgttaatcgcatggtcgatgagggtaagttataccttttccagatctataataaagacttttcgccccagtcgaagggaactccgaatatgcacaccttgtattggcgcatgcttttcgacgaacgcaacctgcacaatgttatttacaagttaaatggtgaagccgaggttttctatcgtaaggcatcactgcgttgtgatcgtccgacgcacccggcacatcaacccatcacgtgcaagaacgaaaacgattcgaaacgtgtctgtgtattcgactatgacatcatcaaaaaccgtcgctacactgtggataagtttatgtttcatgtccccattacgatcaattacaaatgtacaggaagcgacaacattaaccagcaagtatgcgattacttgcgtagcgcgggagatgatacacacatcattggtattgatcgtggtgagcgcaacttgctgtatcttgtgattatcgatcaacacggaacgattaaagagcagttttcgttgaacgagatcgtgaatgagtacaaaggcaacacgtactgtacaaactatcacactttgcttgaggagaaagaggcgggtaacaaaaaagcgcgtcaagactggcaaacaatcgagagcattaaagaattgaaggaaggatatttgagccaagtgatccacaaaatctcgatgttaatgcaacgctaccacgctattgtagtattagaggatttgaatggaagtttcatgcgcagccgccaaaaagtagaaaaacaagtttatcaaaagttcgaacacatgttaatcaacaaacttaattatcttgtcaataagcagtatgatgctgcagaaccgggtgggttattgcatgctttacagcttacttcgcgtatggatagctttaaaaagttaggtaaacagtccgggttcctgttttatatccctgcgtggaatacttccaagattgaccctgtcaccgggttcgtaaaccttttcgacacccgctactgcaacgaggcaaaggcgaaggagttttttgaaaagtttgacgatatttcatataatgacgaacgcgactggttcgagttttcattcgattaccgccatttcacaaataagcccacaggaactcgtacccagtggaccttatgcacccaaggcactcgtgttcgcacattccgtaaccctgagaaatcaaatcactgggataatgaggagtttgacctgacccaggcctttaaggatttatttaataaatacggtatcgacatcgcgagcggcttaaaggcacgtattgtcaacggccagcttacgaaggaaactagtgcagtcaaagacttctacgagagtctgctgaagttgttgaagctgactcttcaaatgcgtaattcagttacagggacagacatcgattacctggtgagcccagttgcggataaagatggtatctttttcgattcgcgtacttgcggctcattgctgcctgcaaacgcggatgccaacggagcgttcaacattgctcgtaaggggttgatgctgcttcgccaaattcagcaatccagtattgatgccgaaaaaattcagcttgccccaattaaaaatgaagactggcttgaatttgcacaagaaaagccatatttataa

SEQ ID NO: 73 - DNA, 3774 bp, Artificial Sequence
  Description of Artificial Sequence: Synthetic polynucleotide
atgaaatacacggacttcaccggcatctacccagtttctaagacactgcgcttcgagttgattccacaagggtcgacagtagagaacatgaaacgcgagggtattcttaacaatgacatgcaccgtgcggactcgtataaagaaatgaaaaagctgattgacgaatatcataaagtgttcatcgaacgttgcttatcagatttttcccttaagtatgatgatacaggtaagcacgactccttagaggaatattttttttactatgaacaaaagcgcaacgacaagactaagaaaatcttcgaggatattcaagtggcgctgcgcaagcaaatctcaaaacgctttaccggggacactgccttcaaacgcctttttaagaaggaattaattaaagaggatttgccgtcattcgtaaaaaacgatccagtcaaaacggaacttattaaggagttctcggattttaccacttactttcaggaatttcacaagaaccgcaaaaacatgtatacatcagatgccaaatcgaccgccatcgcatatcgtatcatcaatgagaacctgccgaagtttatcgataatatcaacgcgttccatattgtggctaaagtgccagaaatgcaagagcactttaaaaccattgcggatgaactgcgctctcatcttcaggtgggggatgatattgacaaaatgtttaacttgcaatttttcaataaagtccttacgcagagccagctggccgtatataatgctgtgatcggtgggaaatctgaaggtaacaaaaaaattcaagggatcaacgaatacgtaaatttgtacaaccaacaacacaaaaaggcacgcctgcccatgttaaagttgctttacaaacaaatcttatctgatcgtgtggccatttcttggcttcaggacgagtttgataacgaccaggacatgttagacacgattgaagccttttacaacaaacttgactcgaatgaaaccggcgtgttgggtgaggggaagctgaagcagattttaatgggcctggatgggtacaaccttgacggcgttttcctgcgcaatgacctgcaattgtccgaagtatcgcagcgtctgtgtggaggctggaacattattaaggatgctatgatttctgatttgaaacgttccgtccaaaaaaaaaaaaaggaaacgggagcggatttcgaagagcgtgtctctaagctttttagcgcccaaaactccttctctatcgcatatattaatcagtgccttgggcaggcaggtattcgctgtaaaatccaagactactttgcatgcttgggcgccaaagagggcgaaaatgaagcagagacgacaccagatatctttgaccaaatcgccgaagcctaccatggtgcggcacccattttgaacgctcgcccaagctcacacaatttggcacaggatatcgaaaaggtaaaggctatcaaagccttacttgacgccttgaagcgcttacagcgttttgtgaagcctttattaggccgtggcgacgaaggtgataaagattcttttttctacggtgacttcatgcctatttgggaggtgttagaccaactgactcccctgtacaataaggtgcgcaatcgtatgactcgcaaaccttacagccaagagaagatcaagcttaactttgagaactcaacacttttaaatggatgggacttaaataaagaacatgataacacatctgtgattttacgtcgtgagggcttgtactatttaggcattatgaataaaaactacaataagatttttgacgcgaacaatgtagagacaattggcgactgttatgaaaagatgatttacaagttgcttccaggtccaaataaaatgttgccgaaggtctttttttcgaaatcacgcgtccaagaattttctccaagcaaaaaaatccttgaaatctgggaatctaaaagttttaagaaaggagacaattttaatttagacgattgtcacgcgctgattgacttctacaaagatagcattgccaaacacccggattggaacaaattcaatttcaagttcagtgacacgcagtcgtatacgaacatcagtgatttctatcgtgatgttaatcaacagggttattcgttatccttcacaaaggtgtcagtagactatgttaaccgtatggtcgacgaaggcaagctttatcttttccagatttataacaaggacttttcgcctcaatcaaagggtacgccgaacatgcataccctttactggcgcatgcttttcgatgagcgcaatttacacaacgttatctacaaactgaacggcgaggctgaggttttttatcgcaaagctagtttgcgttgcgaccgtccaacccatccggcgcaccagcccatcacctgtaaaaatgagaacgattccaagcgcgtttgcgttttcgattacgatattatcaagaaccgtcgttatactgtagacaagtttatgtttcatgtaccgattacgattaactataagtgcactgggtcggacaatattaatcagcaagtatgtgactatttgcgcagcgctggcgatgatactcacatcatcggcattgatcgcggagaacgcaatttattgtaccttgtgatcattgaccagcatggaacgatcaaggagcagttctcattaaacgaaattgtcaatgaatacaagggtaatacctactgcactaattatcataccttgcttgaagagaaagaagcgggcaacaagaaggcccgtcaggattggcaaacgattgaatctatcaaggaacttaaggaaggatatctttcgcaggttattcataaaattagcatgcttatgcaacgctatcatgctattgtagtcctggaggatcttaacggtagctttatgcgctctcgccaaaaggttgaaaaacaagtctatcaaaaattcgagcatatgctgattaacaaacttaattatctggttaacaagcagtatgacgccgcggagccgggcgggcttcttcacgctcttcaattaacttcccgtatggacagttttaaaaagctggggaaacagtctggttttttattttacatccccgcttggaatacatcaaagattgatccagtcacggggtttgtcaacttgtttgatacacgttattgtaacgaggctaaagcgaaagaattttttgaaaaattcgacgatatctcctataacgatgaacgtgattggtttgagttttcattcgactatcgccactttacgaacaaaccgacgggtactcgtacccagtggactttgtgcacacaaggtacacgtgttcgcactttccgcaacccggaaaagagtaatcattgggataacgaagagttcgaccttactcaagcgttcaaagatttgtttaataagtatggaattgatatcgctagtgggcttaaggcgcgcatcgttaatggccagttaaccaaggagacctcagctgtgaaggatttctatgaatccttgctgaaattactgaagcttacattacaaatgcgtaactctgtgaccgggaccgatatcgattatctggtcagcccggttgctgacaaggacggtatcttcttcgattcgcgtacttgcggtagtttgcttcccgccaacgcggatgcaaacggagcctttaatattgctcgtaaagggttaatgcttcttcgccaaatccaacagtcctctatcgacgcagaaaagattcagttggcacccattaagaacgaagattggttggagtttgcccaggagaagccctacttgtaa

SEQ ID NO: 74 - DNA, 3774 bp, Artificial Sequence
  Description of Artificial Sequence: Synthetic polynucleotide
atgaaatatactgacttcactggcatctatcctgtgtccaaaacccttcgcttcgaattgattcctcaaggttccacggtagaaaatatgaaacgcgaggggattctgaacaatgacatgcatcgcgcagattcttacaaagagatgaaaaagttgattgacgagtaccataaggtctttatcgaacgctgtctgagcgacttctccctgaagtatgatgatacggggaagcatgatagcttagaagaatacttcttctattacgaacaaaagcgcaacgataaaacaaagaagattttcgaagatatccaagttgcattgcgcaaacaaatcagcaaacgttttacgggggataccgcattcaagcgtttatttaagaaggagcttatcaaggaggatttgccatcgttcgtcaaaaatgacccggttaagactgagcttatcaaagaattttcagacttcacaacttactttcaggagttccacaaaaatcgtaaaaacatgtacacaagtgatgcgaaatctacagccatcgcataccgtatcattaatgaaaaccttccaaagttcatcgataacattaatgctttccacatcgttgcaaaagtacctgaaatgcaggaacacttcaaaactatcgcagatgaattgcgttcgcatttacaagtcggggatgatattgacaaaatgtttaatttacagttttttaataaggtgttgacccaatctcaattggcggtctataacgcagttattggtggcaaaagcgaagggaacaaaaagatccaaggcatcaacgaatacgttaatttatacaaccaacagcacaagaaggcgcgcttgcccatgttgaaactgttatataaacagatccttagtgaccgtgttgcaatctcgtggttgcaggatgaatttgacaatgaccaagatatgttggacaccatcgaggccttttacaataagttagacagcaatgaaaccggagtactgggcgaaggaaagttgaaacaaatcttaatgggtcttgatggatataacctggatggcgtatttttacgcaacgatttacaacttagtgaagtttcccaacgtctgtgtggcgggtggaacattattaaggacgcgatgatttctgatttgaaacgttcagtgcaaaagaaaaaaaaagaaacaggggccgattttgaagaacgcgtcagcaaattattctctgcacaaaattcgttttcaattgcttacattaatcaatgtttggggcaggctggcattcgctgtaaaattcaagattacttcgcttgccttggtgcaaaggagggtgaaaacgaggctgaaaccacaccggatattttcgaccaaattgccgaagcgtatcatggcgccgcaccgatcttaaatgcgcgtccctcttcgcacaatctggcacaggatattgaaaaagtcaaagctattaaggctcttttagacgcattaaagcgcttgcaacgttttgtaaaacctcttttaggccgtggcgatgaaggagacaaagattctttcttttacggcgacttcatgccaatctgggaggttttagaccagttaacgccgctgtataataaggtgcgcaaccgcatgacgcgtaaaccatactcacaagagaaaatcaagttgaactttgagaactcgactttgctgaatgggtgggatttgaataaagagcacgataacacaagtgtaattctgcgtcgcgaggggttgtactatttaggaattatgaataaaaattacaataagatttttgatgcaaataacgtagaaacaatcggcgactgttatgagaaaatgatctataagcttttacccgggccaaataaaatgttaccaaaagtgtttttttcaaaaagtcgcgtacaggagttctccccgagcaagaagattctggaaatctgggagagcaagtctttcaaaaaaggtgacaatttcaacttagacgattgccacgcgcttattgacttttacaaagacagtatcgcgaagcaccccgattggaacaaatttaatttcaagttttcagacacgcagtcttacacaaacatttctgatttttatcgtgatgtaaaccagcaggggtactccttgtccttcactaaggtaagtgtagattatgttaatcgtatggtagatgaggggaagttgtaccttttccaaatctacaacaaagattttagtccccaatcaaagggtacgccgaacatgcacactctgtattggcgtatgctttttgacgagcgcaaccttcataatgttatctacaagttaaacggagaagcagaggtattttatcgcaaagcctctcttcgctgcgaccgcccgacacacccagcccatcagcctatcacatgcaaaaacgagaacgatagtaaacgtgtgtgtgtgttcgattatgacatcattaagaaccgtcgctataccgtcgacaagttcatgtttcacgttcccattacaattaactataagtgcacgggatcggacaatatcaaccaacaggtctgcgactacttgcgcagcgctggcgacgacactcacatcattggtattgatcgtggtgagcgcaacttattatacctggtaatcattgaccaacatgggaccattaaggagcagttttctttgaacgaaattgtcaatgagtacaaaggtaacacgtattgcaccaattatcatactctgctggaagagaaagaggccgggaataaaaaggcacgccaagactggcagacaattgagtcgattaaagaactgaaagaagggtaccttagccaggttatccataagattagtatgttgatgcaacgctaccacgcaattgtcgtattggaggacttaaatggtagctttatgcgctcccgccagaaagtcgaaaaacaggtctaccaaaaattcgagcacatgttgatcaataagttgaattacctggtaaataaacaatacgatgcggccgaaccgggtggcctgttgcacgccttacagttgacctcccgtatggattcctttaagaaattgggcaagcaatctggctttcttttttatatcccggcatggaatacttcgaaaattgaccccgttacgggttttgttaacttattcgacacccgttattgtaatgaagcgaaggccaaggaattctttgaaaagtttgacgatatcagttataacgacgagcgcgattggttcgagttttccttcgattatcgccacttcacaaataaacctactgggacgcgtacccagtggactctttgtacccaagggactcgtgtccgtacctttcgcaatcccgaaaagtcaaatcactgggacaatgaggaatttgatttgactcaggcgtttaaagaccttttcaataagtatggtatcgacattgcgtctggtcttaaggcacgtatcgttaatggccagcttaccaaagagacctctgcggtgaaagacttctatgagtctctgttgaaactgttaaaactgacgttgcaaatgcgcaactccgtcacaggaactgatattgactacttagtgagccctgtcgcagataaggacggtatttttttcgattcacgcacgtgtggcagtttactgcccgcaaatgcggatgccaatggcgcgttcaatattgcgcgtaaggggttgatgttactgcgccagattcagcagtcatcaattgatgcggaaaaaattcagttagcccccatcaaaaatgaggactggttggaatttgcgcaagaaaaaccttacctgtaa

SEQ ID NO: 75 - DNA, 3738 bp, Phocaeicola sp.
atggaaacattttctgggtttacaaatttgtaccctttgtcaaagacattgcggtttagattgattcctgtaggggaaacattgaaatattttattggtagtggaatattggaagaagaccagcatagggctgagagctatgtgaaggtaaaggctattattgatgactatcatagagcttatattgagaattctttatcaggctttgaattacctttggaaagtacgggtaaattcaattctttggaggaatattatttgtatcataatattcgcaataaaacggaagaaattcagaacttgtcatccaaggtcagaactaatctgaggaaacaagtcgtggctcaactaactaagaacgaaatatttaaaagaattgataaaaaagagctgattcagagtgatttgattgattttgttaaaaatgagcctgatgcaaatgagaaaatagcactaatctcagaatttcgtaattttactgtatatttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatagtgaatttctggaatactattcatgatacagttcttgcagaaggagggttgaaaacgattattgcttcattgggtagttatggccttgaaggtattttcctaaagaatgatttgcaacttactgatatatcacaaaaggcaacaggtagttggggtaaaatatcttctgagataaagcaaaaaatagaggtgatgaatcctcaaaagaaaaaagagtcttatgagacttatcaagaacgtatagataagatattcaagtcttataaaagtttttctttagcttttataaatgagtgccttcgtggtgagtataagattgaagattattttctcaagttaggggctgtgaatagcagttcgttacagaaagaaaatcatttttcgcatattctcaatacctatacagatgtgaaagaggtgattggcttttactctgaatcgactgacactaaattaatacgagataatggttccattcaaaagataaaactgtttcttgatgcggttaaagacttacaggcttatgtaaaaccattattgggtaatggtgatgaaaccggtaaagatgaaagattttatggcgatttgattgagtattggagtttgcttgacttgattactcctttatataatatggttcgtaattatgtcactcagaagccgtattctgtagataaaataaaaataaatttccagaatcctactttattgaatggctgggaccttaataaagaaacggataatacatctgtaatattgcgtcgtgatggcaaatattatctggccataatgaataacaaatccagaaaagtctttttgaaatatccatcagggacagatagaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtgtataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagttggcaaagtatagctaacataaaagacttgaaagaaggctatttaagtcaggttattcataagatttctgaattgatggtcaaatataatgcgattgtggtgcttgaggatttgaatgctggatttatgcgtggtcgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatactttaggtaaacaaagcggatttctcttttatatccccgcctggaataccagtaaaatggatccggtaacaggttttgtaaatttgtttgatgtgaagtatgaaagtgttgataaggcaaaaagctttttcagtaagttcgattctataaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggcatcgacttatcttcaaatctgaaagatgagataatgcaacgtacagaaaaagaattctttatcgaacttatatccctatttaagcttgtgctacagatgcgtaatagttggacaggtactgatatagattatctggtatcacctgtatgcaatgaaaacggtgaatttttcgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 76 - DNA, 3738 bp, Artificial Sequence
  Description of Artificial Sequence: Synthetic polynucleotide
atggagacattcagcggctttactaatttatacccacttagtaaaactcttcgttttcgtttaatccctgttggcgaaactttgaaatacttcatcgggtcaggtattttggaagaagatcaacaccgcgcagagtcatacgtaaaagtcaaagccatcattgacgactaccaccgtgcttatatcgaaaattctctgtctggttttgaactgcctttggaatcaactgggaagttcaatagtcttgaagaatactatctgtaccacaatatccgcaataaaacagaggaaattcaaaacttgtcgtcaaaagtccgtactaacttgcgcaagcaagtcgtggcgcagttaaccaaaaatgagatcttcaagcgtattgacaaaaaagaactgatccaatcagacttaattgatttcgtaaagaatgaaccagacgcaaacgagaaaattgcactgatctcagagttccgtaattttacggtgtattttaaagggtttcatgaaaaccgtcgcaacatgtattccgatgaggagaagtcgacttccattgctttccgcttgattcacgaaaatttgcccaaattcattgacaatatggaggtttttgcaaaaattcagaacacgtcaatttcggagaacttcgacgcgattcagaaggagttgtgtcctgagctggttacgttgtgtgagatgttcaaactgggatactttaataagactctttcgcaaaaacaaatcgacgcttacaatacagttattggcgggaagactactagcgagggcaaaaagatcaagggtttgaatgaatatatcaacttgtataatcagcaacataaacaggagaaacttcccaagatgaagcttctgttcaaacaaatcttgtcagaccgcgaatcagcctcatggttgccagagaagttcgaaaacgacagccaagtcgtaggggctattgtaaacttctggaatactattcacgatactgtgttggccgaaggtggattgaagacgatcattgcgagcttaggctcttacgggttagaggggatcttcctgaaaaacgatttgcaactgacggacatttcccaaaaggctactggaagctgggggaagattagctccgagatcaagcaaaagatcgaagttatgaacccccagaagaaaaaagaatcgtatgaaacttaccaggagcgcatcgataaaatttttaagagctataaaagtttttctcttgcttttatcaacgaatgcttacgtggggagtataagatcgaggattatttcctgaagctgggtgcggtaaactcctcatctttacagaaggaaaaccatttttcacatattctgaatacatatactgacgttaaggaggtgattggattttattcagaatctactgacaccaaattaatccgtgataatgggagtattcaaaaaattaaattgtttttggatgcagtaaaagaccttcaggcgtacgtcaagcctcttttgggaaatggggacgaaacagggaaagatgagcgtttctatggggaccttattgagtattggtcacttcttgatttgattacaccactttataatatggtccgtaactacgtcactcagaaaccatactcagtagataagatcaaaattaatttccagaacccgaccttgctgaacggctgggatttaaacaaagaaactgataacacaagcgttatcttacgtcgcgacggaaagtattaccttgccattatgaataataaaagtcgtaaagtctttttaaagtatccgtcgggtacggaccgtaactgttatgaaaaaatggagtacaagcttctgccgggtgctaataaaatgttacccaaagttttctttagtaaaagccgtattaacgaatttatgcctaacgagcgtcttttgtctaattatgagaagggtactcacaaaaaaagtgggacctgcttctcgttagatgattgtcatacacttattgactttttcaaaaagtcgcttgacaaacacgaggactggaagaactttgggtttaaattctctgatacgagcacctatgaggacatgtcaggtttctacaaagaggtcgagaaccaggggtataagttgagttttaagcctatcgatgcgacttatgtagatcagttggtagacgaaggaaaaatttttctttttcaaatttacaataaagatttctccgaacacagcaaggggactcctaatatgcacactttgtattggaagatgctgttcgacgagactaacctgggagacgttgtctacaagttgaatggagaggcggaggtattttttcgcaaggcgtctattaacgtttcgcaccccacgcaccccgccaacattcctatcaagaagaaaaacctgaagcataaggacgaagagcgcattcttaaatatgacctgatcaaggataagcgctatactgtcgatcaattccagtttcacgtaccgattactatgaatttcaaagcagatggaaacggtaatatcaatcaaaaggctattgactatttacgtagtgcttctgacactcacatcatcggaattgatcgcggagagcgcaatctgttgtatcttgtggtcatcgatgggaatggcaaaatctgtgaacagttctcgctgaatgaaattgaggtggaatataatggcgaaaagtactctacgaattatcatgatttgcttaatgtgaaggagaacgaacgtaagcaagcgcgtcagtcatggcagtctattgctaacattaaggacttaaaggaagggtatttgagtcaagtgattcataaaattagtgaattaatggtaaagtataatgcgattgttgtcttagaggatctgaacgcgggcttcatgcgtgggcgtcagaaagtggaaaagcaagtctatcaaaaattcgaaaagaagttaatcgagaaattaaactacctggtattcaaaaagcagtcgtccgatttgcccggaggattaatgcatgcttatcagcttgcgaataaatttgagagtttcaatacgctggggaaacagagcgggtttttattctatatccctgcctggaatacaagtaagatggaccctgtgacaggcttcgtcaatttgtttgacgttaagtatgaatcggtcgacaaagcaaaaagtttcttcagcaaatttgactccatccgctataatgttgaacgcgatatgtttgagtggaaatttaattatggggaattcaccaaaaaggcggaaggcacaaaaactgattggacagtgtgctcttatggcaaccgtattattacgtttcgtaaccctgataagaactcccaatgggataacaaagagatcaaccttacggaaaatatcaaactgttattcgaacgttttgggatcgatctttcttccaacttaaaggacgaaatcatgcaacgcactgagaaggagttttttatcgaactgatttcgttgttcaagctggtacttcagatgcgtaattcctggacaggaacggatattgattatttagtatcccccgtttgcaatgagaatggcgaattttttgactcacgcaacgtcgacgagaccttgcctcaaaacgcagacgctaacggggcttacaacatcgcacgcaaggggatgatccttttagacaaaatcaagaagagcaacggtgagaagaagctggccttgtcaattactaatcgtgagtggctttcatttgcgcaaggttgttgtaaaaacggctga

SEQ ID NO: 77 - DNA, 3738 bp, Artificial Sequence
  Description of Artificial Sequence: Synthetic polynucleotide
atggaaacgtttagtgggttcacaaacctttatccgttatcaaaaactcttcgcttccgtcttattcccgttggcgagacgttaaaatatttcattggctcagggatcttagaggaagatcaacatcgcgccgagtcttacgttaaggtgaaagcgattatcgacgattaccatcgcgcttatattgagaacagcttaagcgggttcgaattacctctggaatctactgggaagtttaacagccttgaggaatattacctttatcataacattcgcaataagacagaagagattcagaatttgtcctccaaagtacgtaccaatcttcgcaaacaagtcgtcgctcagttgactaagaacgaaatctttaaacgcatcgacaaaaaggaactgatccagtctgacctgattgattttgtgaagaatgagccggatgccaatgagaagatcgctctgatttccgaatttcgtaattttacagtgtactttaagggtttccatgagaatcgtcgcaacatgtacagtgacgaagaaaaatctacgtccattgctttccgtttaattcacgagaatctgcctaaattcattgataatatggaagtattcgctaaaattcaaaatacttcaattagcgaaaattttgacgcgattcaaaaagaattatgcccggaactggtgacattatgtgaaatgtttaaacttgggtattttaacaagaccttatctcaaaaacaaattgatgcgtataatacagtcatcggtggaaagactactagcgaaggaaaaaagatcaaagggcttaatgaatatattaacctttataaccaacagcataagcaagagaagcttcccaagatgaaacttctgttcaagcagattttgtcggaccgtgagagcgcttcatggttgccggagaagttcgagaacgactcccaagtagtgggagctatcgtaaacttttggaatactatccatgacacagttcttgcggaaggcgggcttaagaccattatcgcctcccttggttcatatggcttagaagggatctttttaaagaatgacctgcagcttaccgacatctctcaaaaagccacaggaagttggggaaagatctccagtgaaattaaacaaaaaatcgaagtgatgaaccctcaaaaaaaaaaagagtcgtatgagacctatcaggaacgcattgataaaatctttaaatcatataagtcgttttcactggcttttatcaacgagtgtctgcgtggagagtataaaatcgaagattatttcctgaaactgggagccgtgaacagttcctctcttcagaaagagaaccacttctcacacattttgaatacgtatacagatgtaaaggaagtaatcggcttttactcggaaagcacggatacgaaacttatccgcgataacggatctattcaaaagattaaattgtttttagacgcggtaaaagatctgcaggcgtacgtaaagcctttgcttggaaacggggacgagactgggaaagacgaacgtttttacggtgaccttatcgagtactggtcactgttagatctgattactccactgtataatatggtgcgcaactacgtgacacaaaagccttattcggttgataaaatcaagattaactttcagaatccaactttgcttaatggatgggacctgaacaaagagactgataacacgtcagtcatccttcgtcgtgacgggaagtattacttggctatcatgaacaataaatcacgtaaggtcttcttaaagtacccgtcggggacagatcgcaactgctacgaaaaaatggagtacaagttgcttcctggagcgaacaagatgcttccgaaagtcttcttcagtaaatcgcgcattaatgagttcatgccaaatgaacgccttctttccaactacgagaaagggacacataagaagagtggtacctgtttctcgttagacgactgccataccctgattgatttcttcaagaagagtcttgacaagcatgaagactggaaaaattttgggttcaaattttctgatacttccacgtacgaggacatgtctggattctataaagaagtggagaaccaaggctacaagttgtctttcaaaccaattgatgcaacgtatgtagaccaactggttgatgaaggcaaaattttcctgttccagatttataataaagatttctcggaacactctaaggggacccccaatatgcacacgttatattggaagatgttattcgacgagactaaccttggcgacgtggtttataaattgaatggtgaggcggaggtgttctttcgtaaagcaagcatcaacgttagtcacccaactcatcctgcaaacattccaattaagaagaagaatttgaagcacaaggatgaggagcgcattttaaagtacgatcttattaaagataaacgttatacggtcgaccagtttcaatttcatgttccaatcacgatgaattttaaggccgatggtaatggaaacattaaccagaaggcaattgattatcttcgctctgcatcggacacgcacatcattggaattgaccgtggggaacgcaacttgttatatctggtggtgatcgatggtaacggaaaaatttgtgaacagttctcgttgaacgagattgaagtcgaatataacggcgagaagtattcgacgaattaccacgatttgctgaatgtgaaagagaatgaacgcaagcaagcgcgccaaagttggcagtcaattgcgaatatcaaggacttaaaagaaggctatctgtctcaggtaattcataaaatctccgaacttatggttaaatacaacgcgattgtggtcttggaagatttgaatgccgggtttatgcgtgggcgccaaaaggtggaaaagcaggtgtaccaaaagtttgagaaaaaactgatcgaaaaattaaattatttggtattcaagaaacagtcttcagacctgcctggtggacttatgcacgcataccaattagccaacaagtttgaaagttttaacaccctgggtaaacagtctggcttcttgttttatatccctgcctggaatacatcaaagatggatccagtaactggttttgtgaacttatttgatgtaaaatatgaatccgtagataaagcgaagtctttttttagtaagtttgattcaatccgctacaatgttgagcgcgatatgttcgagtggaagttcaactatggtgagttcaccaagaaagcagaaggaaccaagacggactggacggtttgttcctacggcaatcgtatcatcactttccgcaacccagataagaactcgcaatgggataacaaggagatcaatttgacggaaaacattaaattgttatttgagcgtttcggcattgacctgtcgagtaacctgaaagatgaaattatgcagcgtacagaaaaagagttttttattgaattaatctcgttgtttaaacttgtcttacaaatgcgcaacagttggacaggtacggacattgattatttggtatccccagtatgcaacgagaacggggagttttttgactcccgcaacgtcgacgagactttgccgcagaacgccgatgcgaacggcgcctacaatattgctcgtaagggtatgatcttattggataaaattaaaaaatcaaatggtgaaaagaagttagcactgagtatcaccaatcgtgagtggttaagtttcgcacaggggtgctgcaagaacggatga

SEQ ID NO: 78 - DNA, 3738 bp, Artificial Sequence
  Description of Artificial Sequence: Synthetic polynucleotide
atggaaacgttctccggatttacaaatttatacccattaagtaagacgttacgttttcgtcttatcccggttggtgagacgttaaaatactttatcggcagcgggatcttggaagaagaccaacatcgcgccgaatcatatgtcaaggtaaaggctattattgacgattaccatcgcgcttatatcgagaactcccttagtggtttcgaacttccccttgagtccacagggaagtttaatagtttggaggaatactacttgtaccataatatccgtaataaaaccgaagaaatccagaaccttagcagcaaggtgcgtaccaacttgcgcaaacaggtagtcgcccaacttactaaaaacgaaatctttaaacgcattgataagaaagagttgattcagagtgatttaatcgattttgtaaagaacgaacccgatgctaatgaaaagattgcccttatttccgaattccgtaattttacagtatattttaagggatttcacgaaaaccgccgcaatatgtactccgacgaggaaaagtcaactagtatcgcgtttcgtttgattcatgaaaacttgcccaaatttattgataacatggaggtttttgcgaagattcaaaacacaagcatttccgagaacttcgatgcgattcaaaaggagctttgcccggaattggtcacattatgtgagatgttcaagctgggctatttcaacaagactttatctcagaagcagatcgacgcttacaatacagtgatcggaggcaaaaccacatcggaaggaaagaaaatcaagggcttgaacgagtatatcaacctgtataaccagcaacataagcaagaaaaacttcccaagatgaaattacttttcaagcaaatcttatctgaccgtgagtcggccagctggcttcctgaaaagtttgaaaacgactcacaagttgtcggtgcaatcgttaatttttggaacaccattcatgatacggtcttagcagaggggggcttaaagactattatcgcttcgttggggtcgtacggtctggaaggtatttttttgaaaaacgatttacaattaacagacatcagccaaaaagccacgggatcctgggggaagatttcaagtgagattaaacagaaaatcgaagtaatgaatccccagaaaaagaaggaatcttatgaaacttaccaggaacgtatcgataagatttttaaatcgtataaaagtttttctttagcttttattaatgaatgccttcgcggtgaatacaagatcgaagactacttccttaagttaggtgcggtcaatagcagttctttacaaaaggagaaccatttctcccacattcttaatacatatacggacgttaaagaagtcattggattttactctgagtcgacagacactaaattgatccgcgacaacggttcgattcaaaaaattaagttattcctggacgccgtgaaggatcttcaagcgtacgtcaagcctctgttggggaatggcgatgaaacgggcaaggatgaacgcttttacggtgatttgatcgagtactggtcgcttcttgatttaattactccactttataatatggtgcgtaattatgtgactcagaaaccctatagcgtagacaaaattaaaatcaatttccaaaaccctacgcttctgaacgggtgggacttgaataaagaaacagacaacacttcagtcattttgcgccgtgatgggaagtactatttagcgatcatgaacaacaagtcccgcaaggtatttcttaaatacccgtcgggaacggaccgtaattgttatgaaaagatggagtacaaactgttaccaggggcaaataagatgttacctaaagtattcttcagtaagtcgcgcatcaatgagtttatgcccaatgaacgccttttgagcaactacgaaaaagggacgcataaaaagtccggtacttgcttcagtttggatgattgtcacactttgatcgactttttcaagaagtcgctggataagcatgaagattggaagaacttcggctttaaattctccgatacgtctacttatgaggacatgtcggggttttacaaggaggtggagaatcaagggtacaagttatcatttaagcctatcgatgccacgtacgttgatcagttagtagatgaaggtaaaatttttttgtttcaaatctataacaaagatttctcagaacactcgaagggcactcccaatatgcacactctttattggaagatgctgtttgacgaaacgaatttgggtgacgtggtttataagcttaacggcgaggcggaagtgttctttcgtaaggcaagtattaacgtctctcacccaacccacccggcaaatattccgatcaaaaagaaaaatctgaagcacaaagacgaggagcgcatcttaaaatacgatcttatcaaggataaacgttacacggtagaccagttccagttccacgtaccgatcacaatgaacttcaaggcagatggaaacgggaacatcaatcagaaagcgatcgattacttgcgcagcgcgtcagatacacatattattgggattgatcgtggtgaacgcaacctgctgtatcttgttgtcattgatggcaacgggaaaatttgtgaacagttttctttgaacgagattgaggtggagtataacggagagaagtatagcaccaattaccatgatttgttgaacgtgaaagaaaatgaacgtaaacaggcgcgccagtcttggcagtccatcgccaatattaaagacttgaaagaaggctacttatcacaagtaatccacaaaattagcgaattaatggtaaaatataatgccatcgttgtcttagaggacttaaacgcaggattcatgcgtggccgccaaaaggtcgagaagcaggtgtaccaaaaatttgagaaaaaactgatcgagaagctgaactacttagtttttaagaaacaatcgagcgatttaccaggcggcttgatgcacgcatatcagttggcaaataagttcgaaagctttaatactcttgggaaacaatcgggctttctgttttatatccccgcatggaacacgtcaaaaatggaccctgtgacagggttcgtgaatttatttgatgttaagtacgaatcagtcgataaagcgaaaagctttttctccaaattcgatagtatccgctacaacgtcgagcgcgacatgtttgaatggaagttcaattacggggagtttaccaagaaagccgaaggcaccaagacagattggactgtgtgctcctatgggaaccgcattatcaccttccgtaatcccgacaagaactctcaatgggataacaaggagatcaacttgaccgaaaatattaaactgctttttgaacgttttggaatcgaccttagttccaaccttaaggatgaaattatgcagcgtacagaaaaggaatttttcatcgagctgatctccctttttaaacttgtccttcagatgcgcaactcatggactgggacggacatcgattacctggtttcccccgtttgtaacgagaacggcgagttctttgattctcgcaacgtcgacgagacgctgcctcagaacgcagatgcgaacggggcctataatattgcacgtaagggcatgattctgctggacaagattaagaagagtaatggggaaaaaaagttagcactttccatcacgaatcgcgaatggttatcctttgctcagggttgctgcaaaaatggatga

SEQ ID NO: 79 - DNA, 3738 bp, Phocaeicola sp.
atggaaacattttctggatttacaaatttgtatcctttgtcaaagacattgcggtttagattgattcctgtaggggaaacattgaaacattttattgatagtggaatattggaagaagaccagcatagggctgagagttatgtgaaggtaaaggctattattgatgactatcatagagcttatattgagaattctttatcaggctttgaattacctttggaaagtacgggtaaattcaattctttggaggaatattatttgtatcataatattcgcaataaaacggaagaaattcagaacttgtcatccaaggtcagaactaatctgaggaaacaagtcgtggttcaactaactaagaacgaaatatttaaaagaattgataaaaaagagctgattcagagtgatttgattgattttgttaaaaatgagcctgatgcaaatgagaaaatagcactaatctcagaatttcgtaattttactgtatacttcaaaggttttcatgaaaaccgtagaaatatgtattccgatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccagcagcataagcaagagaaattacccaagatgaagcttcttttcaagcagatacttagtgatagagaaagtgcgtcatggctgccagagaagtttgagaatgatagtcaggttgtcggtgcaatggtgaatttctggaatactattcatgatacagttcttgcagaaggaggattgaaaacgattattgcttcattgggtagttatggccttgaaggtattttcctaaagaatgatttacaacttactgatatatcacaaaaggcaacaggtagttggagtaaaatatcttctgagataaagcaaaaaatagaggtgatgaatcctcaaaagaaaaaagagtcttatgagagttatcaagaacgtatagataagctattcaagtcttataaaagtttttctttagcttttataaatgagtgccttcgtggtgagtataagattgaagattattttctcaagttaggggctgtgaatagcagttcgttacagaaagaaaatcatttttcgcatattctcaatgcatatacagatgtaaaagaggcgattggcttttactctgaatcgactgacaccaaattaatacaagataatgattccattcaaaagataaaacagttccttgacgcagttaaagacttacaggcttatgtaaaaccattattgggtaatggtgatgaaaccggtaaggatgaaaggttttatggcgatttgattgagtattggagtctgcttgacttgattactcctttatataatatggttcgtaattatgtcactcagaagccgtattctgtagataaaataaaaataaatttccagaatcctactttattgaatggttgggaccttaataaagaaacggataatacatctgtaatattgcgtcgtgatggcaaatattatctggccataatgaataacaaatccagaaaagtctttttgaaatatccatcagggacagatggaaattgctatgagaagatggagtataaacttttaccaggtgctaataagatgctacctaaggtcttcttttcaaaatcaaggataaatgaattcatgcctaatgagcgtttgttgtcaaattatgaaaagggcacgcataaaaagtcgggtatttgttttagtttggatgattgtcatactttgatagatttctttaagaagtctttggacaaacatgaggattggaaaaactttggcttcaagttctctgatacttctacatatgaagatatgagtggtttttataaagaagtagagaatcaaggttataaattatcctttaagccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtatataaactaaatggtgaggctgaagtctttttccgtaaggcaagtataaatgtatcacatccaactcatccggctaacatacccataaagaaaaagaatcttaaacataaagatgaagaaagaattcttaaatatgacttgattaaagataagcgttataccgtcgaccagttccagtttcatgtgccaataaccatgaatttcaaggcggatggaaatggaaatataaaccagaaagcgatagactatttatgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaagcaggcaagacagagctggcaaagtatagctaacataaaagacttgaaagaaggctatttaagtcaggttattcataagatttctgaattgatggtcaaatataatgcgattgtggtgcttgaggatttgaacgctggatttatgcgtggccgacaaaaggttgaaaagcaggtttatcagaaatttgaaaagaaactcattgagaagttaaattatctcgtattcaagaaacagtcttctgatttgcctggtgggcttatgcatgcttatcagttagctaataaatttgagagttttaatgctttaggtaaacaaagcggatttctcttttatatccccgcctggaataccagtaaaatggatccggtaacaggttttgtaaatttgtttgatgtgaagtatgaaagtgttgataaggcaaaaagttttttcagtaagttcgattctatgaggtataatgtggaaagagatatgtttgaatggaaattcaattatggtgaattcacgaaaaaagccgaaggaactaaaactgattggactgtttgttcctacggtaatagaattatcacctttagaaatccggataaaaattctcaatgggataataaagaaataaatcttaccgaaaatattaagctgctgtttgaaaggtttggtatcgacttatcttcaaatctgaaagatgagataatgcaacgtacagaaaaagaattctttatcgaacttatatccctatttaagcttgtgttacagatgcgtaatagttggacaggtactgatatagattatctggtatcacctgtatgcaatgaaaacggtgaattttttgatagcagaaacgtagatgaaacacttccgcaaaatgcggacgcaaacggagcatataacattgcaagaaaaggaatgatacttcttgataagattaagaaaagtaacggtgagaagaagcttgctctatctataactaatagagaatggctttcatttgctcaaggttgttgcaaaaatggatga

SEQ ID NO: 80 - DNA, 3738 bp, Artificial Sequence
  Description of Artificial Sequence: Synthetic polynucleotide
atggaaacgtttagtgggttcacgaatctttacccgttatccaaaacgttgcgttttcgccttatcccagtaggggagacgttaaaacattttatcgattcgggcatcctggaggaagatcaacaccgcgccgagtcatacgtcaaggtgaaagcgattattgacgactaccaccgtgcatacattgaaaattcactttctggcttcgaattaccccttgaatctaccgggaaatttaactcccttgaggagtactatttatatcacaacattcgtaacaaaacagaagaaattcaaaatttgtcttccaaagtacgcaccaaccttcgtaaacaggttgtggtccaattgacgaaaaacgaaatcttcaaacgcatcgacaagaaagaattgatccagagcgacctgatcgattttgttaaaaacgaacccgatgctaacgagaagattgcactgatttctgagttccgcaattttacagtttacttcaaaggcttccacgaaaaccgtcgtaacatgtactccgatgaagagaaatcgacatccatcgcgttccgcttgatccacgaaaatttaccgaaattcattgataatatggaggtattcgcaaagattcaaaatacgtccatttcagaaaacttcgatgcaatccaaaaggagctgtgccccgaattggttaccctgtgtgaaatgtttaagttaggttattttaataagaccttgtcgcaaaaacaaatcgacgcctacaacactgttattggtggaaagacaacgtcggagggaaagaaaattaaggggttgaatgagtatattaatctttataatcaacaacacaagcaggagaagttaccaaagatgaaattgcttttcaaacaaatcctttctgaccgtgaaagtgcaagctggcttcccgagaaatttgaaaacgactcccaggtagtgggtgctatggtaaatttttggaataccatccacgacaccgtgttggctgaaggtggccttaaaactatcatcgcaagtcttgggtcgtatgggctggagggtatcttcttgaagaacgatcttcagcttacagacatttcccagaaagcaacaggttcctggagcaagatctcttcggaaattaagcaaaagatcgaggtcatgaacccacagaaaaaaaaggaatcctacgagagttatcaagaacgtatcgataaactgtttaaaagctataaaagtttttcgctggccttcatcaacgagtgcctgcgtggtgagtataaaatcgaagactactttctgaaattgggtgctgtcaatagttcatcgctgcaaaaagagaatcacttcagtcacattttaaacgcctatacagatgtcaaagaggcgattggtttttacagtgagagtacagataccaaattgattcaggacaacgatagcatccaaaagatcaagcaattcttggatgccgtcaaggacttgcaagcgtacgtaaagccgcttcttggcaacggcgacgagacaggcaaagatgagcgcttctatggtgatttgattgaatattggtctctgttagacttaatcacaccgctgtataatatggtgcgtaattacgttacccagaagccttactccgtagataaaattaaaatcaactttcagaatcccacccttcttaacggatgggacctgaataaagaaaccgacaatactagtgttattctgcgtcgtgacggcaaatattatttggcaattatgaataacaaatcgcgtaaggtatttttgaaatacccttccggaactgatggaaactgttatgagaagatggaatataaattgttacccggtgccaacaagatgcttccaaaagtttttttttctaaatcccgcatcaacgagttcatgccgaacgaacgtcttctgagtaactacgaaaaagggacgcataaaaagtcaggtatttgtttctcgctggatgactgtcacacccttatcgacttttttaagaagagcttagataagcacgaagattggaaaaattttggtttcaagttttcagacacatctacttacgaagatatgtcaggtttctacaaagaagtagagaatcagggctataagttatcgttcaagcccatcgatgcaacctacgtggatcagcttgttgatgaagggaagatttttttgtttcaaatctacaacaaagatttctcagagcactcaaaaggaaccccgaatatgcacacattatattggaaaatgttatttgatgagacgaacctgggggacgtagtatacaaacttaacggtgaagccgaagttttctttcgtaaagctagcattaacgtttcgcaccctactcacccagcaaatattccgatcaagaagaagaatctgaaacacaaggacgaagaacgcattttgaaatatgacctgatcaaagacaagcgctacacagtcgatcagtttcaatttcacgttccaatcaccatgaattttaaggccgacggtaatgggaatattaaccagaaggctatcgactacctttgttcggctagcgacacacacattattgggattgaccgcggggaacgcaatcttttgtaccttgttgttatcgacggtaacgggaaaatctgtgagcaattctctcttaatgagatcgaagtagaatataatggagaaaagtatagcacgaactaccatgacctgttaaatgtgaaagaaaatgagcgcaagcaggcacgccaatcgtggcagagtattgcaaacattaaagatctgaaggagggctacctttcacaagtcatccacaaaatctctgagttgatggtgaaatacaatgcgattgtagtattggaagaccttaatgctggatttatgcgtggacgccagaaggtggaaaagcaagtttaccaaaagttcgagaagaaacttattgagaagctgaactacctggttttcaagaagcagtccagcgacttgcccggtggtctgatgcatgcatatcagcttgcgaataagtttgagagcttcaatgcattgggaaagcagtcaggctttctgttttacatccctgcttggaatacatcaaaaatggatcccgtgactgggttcgtcaacttattcgatgtaaagtatgagtcggtagacaaagctaagagcttcttttcaaaattcgatagcatgcgttataatgttgagcgtgacatgttcgagtggaagtttaattatggggaatttaccaagaaagctgaaggtacgaaaaccgactggactgtgtgctcgtatgggaatcgtattatcaccttccgtaacccagataagaactcgcagtgggataacaaagaaatcaatctgacggaaaacatcaaacttttattcgaacgtttcgggattgacctgtctagcaacctgaaggacgaaatcatgcaacgcactgaaaaggaattcttcattgagttgatttcgttatttaagcttgtattgcagatgcgcaacagttggacgggcaccgacatcgattacttggtatctccagtttgtaatgaaaatggcgagttttttgacagtcgtaatgttgatgagactttaccccagaacgctgatgccaacggggcttataatatcgcacgcaaggggatgatcctgttggataaaatcaagaaaagcaatggtgaaaaaaagttagcgctgtcgattaccaatcgtgaatggctgagctttgctcaaggttgctgtaagaatggctga

SEQ ID NO: 81 - DNA, 3738 bp, Artificial Sequence
  Description of Artificial Sequence: Synthetic polynucleotide
atggaaacgttctcaggtttcaccaacttatatccattgtcaaaaactcttcgctttcgcctgatccccgtcggggagacgttaaagcacttcatcgactctggaattttggaagaggaccaacatcgtgctgagtcttacgtaaaagtgaaggctattatcgatgattaccaccgtgcatacatcgaaaatagtttatctgggttcgaactgccattggaatcgacaggcaaatttaacagcttagaagaatactacttatatcacaacatccgtaataaaacagaagagattcagaacctttcctcgaaggtgcgcacgaacttacgcaaacaagtcgtcgttcaattaaccaagaatgaaatctttaagcgtattgataaaaaagagttaattcaatctgatctgattgattttgttaaaaacgagcctgacgcgaacgaaaagattgcgttgatttcggaatttcgtaattttacagtttatttcaaagggtttcacgagaaccgccgcaatatgtactcagacgaggagaagtcaacatccatcgcgttccgtctgatccacgaaaatttgcccaaatttattgacaacatggaggtctttgctaagatccagaatacgtccattagtgagaactttgacgccattcagaaggaactttgtcctgagttggtaaccttatgtgaaatgtttaaattggggtactttaacaaaactctttctcaaaagcagatcgatgcttataatacagttatcggtggcaagacaacctccgaaggcaaaaagatcaagggattgaacgaatatattaacctttataaccagcagcacaaacaggaaaaactgccgaaaatgaaactgttgtttaagcaaattttatcagaccgtgagtccgctagctggttgccggaaaagtttgaaaacgactcgcaggtcgtaggggctatggtaaatttctggaatacaatccatgataccgtccttgcagaaggtgggttaaaaacgatcatcgctagtcttggctcctacggcttggaaggtatcttcttaaaaaacgatcttcagctgaccgacatctcacaaaaggccactgggtcatggtctaaaatttcgagcgagatcaaacaaaaaatcgaggtaatgaacccgcagaaaaagaaggagagttatgagagctaccaggaacgcatcgataaactgtttaagagctataaaagcttttcgcttgcttttattaacgagtgtttacgtggcgaatataagatcgaagattactttctgaagcttggagcggtaaacagtagtagcctgcaaaaagaaaaccatttctcccacattcttaatgcatacacagatgtaaaagaagctatcggattctactccgagtcaaccgacacgaaattgattcaagataatgactcgatccagaagattaaacaatttctggatgcggtaaaggacttacaggcatacgttaaaccactgcttggcaacggcgacgaaacgggaaaagatgagcgtttctatggggacttaattgagtattggtcattactggatttaatcaccccactttacaatatggtgcgtaactatgtgacacaaaagccatattctgtggacaaaatcaagatcaactttcagaaccctactcttctgaatggctgggatcttaacaaagaaacggacaatacgagtgtgattctgcgtcgcgatggaaaatattatcttgcaatcatgaataacaaatctcgcaaggtgtttttgaaatacccatcgggcacagacggaaactgctatgaaaagatggagtataaactgcttcccggggccaacaagatgcttcccaaagtatttttctcaaaatcccgtatcaatgagtttatgcctaatgagcgtcttttgtccaactacgagaagggtacccataagaaaagtggaatctgctttagtttggacgattgtcatacattaatcgatttcttcaagaaaagcttagacaaacacgaggattggaaaaattttggtttcaaattcagcgatacctccacgtacgaagatatgtcgggtttttataaggaagttgagaatcaaggatacaagttatctttcaagcctattgacgcaacgtatgtcgaccaattagttgacgaaggaaagatttttcttttccaaatttataacaaagacttctctgagcactcgaagggtacgccaaacatgcatacactttactggaaaatgcttttcgacgagacgaatttaggagacgttgtctataagcttaatggggaggcagaagtatttttccgcaaagccagcatcaacgtttcgcacccaacccatcctgccaacattcctatcaagaagaaaaaccttaaacacaaagacgaggaacgcattttaaagtatgacctgattaaagataaacgctatactgtggatcaattccagttccacgtgcctattacaatgaatttcaaagcagacggtaacggcaacattaatcaaaaagccattgactatttgtgcagcgcatcagacacacacatcattggtattgatcgtggggagcgcaatttactgtacttagtagtgattgatgggaatggcaaaatctgcgagcaattctcgttgaacgaaattgaagtcgagtataatggagaaaaatactctaccaactaccacgacttactgaacgttaaagagaacgagcgtaaacaagctcgccagtcttggcagtcaattgcgaacattaaggatttgaaagaaggctatctttcacaagtaattcataaaatcagtgaactgatggtaaaatacaatgctattgttgtattggaagacttaaatgccgggtttatgcgtggccgtcagaaagtcgaaaaacaagtctaccaaaaattcgaaaaaaaattaattgaaaaattgaattacctggtattcaaaaagcagtccagtgaccttcccggcggattaatgcacgcctaccaattagcaaacaaatttgagagctttaacgcacttggaaaacagagtggtttccttttctacatcccagcgtggaatacaagcaagatggatcctgtaacgggatttgttaatttgtttgacgtcaagtacgagtccgtggataaggctaaaagtttcttctcgaaattcgattcaatgcgttacaacgttgaacgcgatatgttcgagtggaagtttaactacggcgagttcacgaaaaaagccgaaggaacaaaaacggactggacggtatgctcgtatggaaaccgcatcatcactttccgtaatcccgacaagaatagtcagtgggataataaggaaatcaacttaactgaaaatatcaaacttctgtttgagcgcttcggaatcgacctgagctctaacttaaaagatgagattatgcaacgtaccgaaaaggaattctttattgagttgattagcttgtttaaattggtacttcagatgcgtaacagctggacaggcaccgatattgattacttagtaagccctgtctgcaacgagaatggagaattctttgatagccgcaatgttgacgaaacacttccgcaaaatgcggatgcgaacggagcatataatatcgctcgcaaaggcatgatccttctggacaaaattaaaaagtccaatggggaaaaaaaattggctttatctattacaaatcgcgaatggctttcctttgcccaaggttgttgtaagaacggctga

SEQ ID NO: 82 - DNA, 3738 bp, Artificial Sequence
  Description of Artificial Sequence: Synthetic polynucleotide
atggagaccttctcgggttttactaacctgtacccccttagtaagacgttacgtttccgtctgatcccagtgggggaaacgttgaagcattttattgactccgggattcttgaggaagaccaacatcgtgccgaaagttacgtgaaagttaaggccattatcgacgattatcaccgtgcttacatcgagaacagcctttcaggcttcgagttgcccttagaatctacaggtaaattcaactctttagaagaatattacctttaccacaatatccgtaataagacagaagaaatccagaatctgagttcaaaggtacgcacaaacctgcgcaaacaggttgttgtgcagttaactaagaacgagatctttaaacgtatcgacaagaaagaattaatccagagcgatctgatcgattttgtgaagaatgaacccgatgctaatgaaaagattgctcttatcagcgagtttcgtaacttcaccgtgtatttcaaggggtttcacgaaaaccgtcgcaacatgtactcggatgaagaaaagagcacatcaattgctttccgtctgatccatgagaatcttccaaaattcatcgacaatatggaggtatttgcgaagatccaaaatacttccattagcgaaaacttcgatgctatccagaaagaattatgccccgagttagtcacgctttgcgaaatgttcaaacttggctactttaacaagacactttcacagaaacaaattgatgcttacaatacagtcatcgggggaaagactacttcagaaggtaagaagattaagggtctgaacgagtacatcaatttatataaccaacaacacaaacaagaaaagcttccgaagatgaaattattatttaaacaaatcctttcggatcgtgagtcggcgtcgtggctgcctgaaaaatttgaaaacgactcccaagtcgtcggggctatggttaatttctggaataccattcacgatactgtccttgccgaaggcggtcttaagacgattatcgcttcgcttggaagctacggtttagagggtatctttctgaagaatgacttgcaacttacagacatttctcaaaaagcgactggatcgtggtccaaaatctcatcagagatcaagcagaaaatcgaagtgatgaatccacagaaaaaaaaggaatcctatgaatcttaccaagaacgcatcgataagctgtttaagagttacaagtcgttttctcttgccttcattaatgaatgtctgcgtggcgaatataagattgaagattatttcttgaagttgggtgcagtgaacagctcttcactgcaaaaagaaaaccactttagtcacattctgaatgcttatactgacgtaaaggaggctatcggattctatagtgaaagcactgacacgaaattaattcaggataacgacagcatccaaaaaatcaaacaatttcttgacgcagtaaaggatttgcaagcttacgttaagcccttgcttgggaatggggatgaaactggtaaggatgaacgcttctacggcgaccttattgagtactggtcgttgcttgatctgattacaccactgtacaacatggttcgcaattatgtaacccaaaagccatattcagttgacaagattaagatcaattttcaaaaccccactctgcttaatggctgggacttgaataaggaaaccgataatacgtcagtgattctgcgccgtgatggcaaatattatttagccatcatgaacaacaagtcacgcaaagtttttcttaagtaccccagtgggacggatggtaattgctacgagaaaatggagtataagctgttgcctggagccaataaaatgctgccaaaagtatttttcagcaaatcgcgcattaatgaatttatgcccaacgagcgcctgttatcgaattacgaaaagggtacacacaaaaagtcggggatttgtttcagcttagatgattgtcacacattgatcgattttttcaaaaaaagtttagataaacacgaagattggaagaatttcggctttaaattctcggatacctcaacgtacgaggacatgtcagggttttataaagaagtcgaaaaccagggatataagttgtcattcaaacctatcgacgcaacgtatgtcgaccagcttgtggacgagggaaagatcttcttgttccaaatttataacaaagatttcagcgagcatagtaaaggaactccgaacatgcacacgctgtactggaaaatgttatttgacgaaacaaatttaggcgatgtcgtgtataaattaaatggtgaggcggaagttttcttccgcaaggctagcatcaacgttagtcatcccacacatccggcaaatattccgatcaaaaaaaaaaacttgaagcataaggatgaagaacgtatccttaaatacgatctgattaaggataaacgttatacggtggatcaatttcagttccatgtgcctattacgatgaactttaaagctgacgggaacggcaatattaaccagaaagccattgactatttatgtagtgcttccgacacgcacattatcggtattgaccgcggagagcgtaaccttctgtacttagttgtcattgacgggaacggaaagatctgcgaacaattctcattgaacgaaatcgaggtggaatacaatggggaaaaatacagcacaaactaccacgatcttttaaacgtcaaagagaacgagcgcaaacaagctcgtcagagctggcagtctattgccaatattaaagacttaaaggagggatacctgtcgcaagtcattcataaaatcagtgaacttatggttaagtacaatgcgattgtagtccttgaagacctgaacgctgggttcatgcgcggacgtcaaaaagttgagaaacaggtatatcagaagttcgagaaaaagttaattgagaagctgaattacctggtcttcaagaagcagtcgtcggatctgccgggagggctgatgcacgcttaccagctggctaataaattcgagtctttcaacgcattaggcaaacaaagcggattcttattttacatcccagcttggaatactagcaaaatggatccagtcacaggctttgtgaatttatttgacgtaaaatacgagtctgtagataaggctaagtcgtttttcagcaaattcgacagtatgcgttacaacgtcgaacgcgacatgttcgagtggaaatttaactacggggaattcacgaaaaaggccgagggaactaaaacggattggacagtctgctcctacggtaatcgtatcatcacttttcgtaacccggacaagaattcccagtgggacaacaaagaaatcaacttaactgagaacatcaaattgcttttcgagcgctttgggatcgatttgtcctccaaccttaaagatgagattatgcaacgcacggaaaaggagttcttcatcgagctgatcagtcttttcaaattagtgcttcaaatgcgtaacagctggaccggtacggatattgactaccttgtgtcccctgtgtgtaacgagaacggagaattttttgactcgcgtaacgtcgacgaaaccttgccacaaaatgccgacgccaacggtgcttacaatattgctcgtaagggcatgattcttcttgataagatcaaaaagagtaatggagagaaaaaattggcattatcaattacaaatcgcgagtggctgtcttttgcacaagggtgttgtaaaaatggatga

SEQ ID NO: 83 - DNA, 3738 bp, Phocaeicola sp.
atggaaacattttctgggtttacaaatttgtaccctttgtcaaagacattgcggtttagattgattcctgtaggggaaacattgaaacattttattggtagtggaatattggaagaagaccagcatagggctgagagttatgtgaaggtaaaggctattattgatgactatcatagaacttatattgagaattctttatcaggctttgaattacctttggaaagtacgggtaaattcaattctttggaggaatattatttgtatcataatattcgaaataaaacggaagaaattcagaacttgtcatccaaggtcagaactaatctgaggaaacaagtcgtgactcaactaactaagaacgaaatatttaaaagaattgataaaaaagagctgattcagagtgatttgattgattttgttaaaaatgaacctgatgcaaatgagaaaatagcactaatctcagaatttcgtaattttactgtatacttcaaaggttttcatgaaaaccgtagaaatatgtattcagatgaagaaaagtccacgtctatagcctttcgtctgattcatgagaatcttcccaagtttattgataatatggaagtgtttgcaaaaatacagaatacttctatctcggagaattttgatgctatacagaaagaactttgcccggagttggtaaccctttgtgaaatgtttaagttggggtattttaataagactttaagtcagaaacaaatagatgcttataatactgttataggtggtaaaaccacatcagaaggtaaaaagattaaaggtcttaatgaatatattaatctttataaccaacagcataagcaagagaaattacccaagatgaagcttcttttcaagcagatacttagtgatagagaaagtgcgtcatggctgctagagaagtttgagaatgatagtcaggttgtcggtgcaatggtgaatttctggaatactattcatgatacagttcttgcagaaggaggattgaaaacgattattgcttcattgggtagctatggccttgaaggtattttcctaaagaatgatttacaacttactgatatatcacaaaaggcaacaggtagttggagtaaaatatcttctgagataaagcaaaaaatagaggcgatgaatccccaaaagaaaaaagagtcttatgagagttatcaagaacgtatagataagctattcaagtcttataaaagtttttctttagcttttgtaaacgagtgccttcgtggtgagtataagattgaagattattttcttaagttaggggctgtgaatagcagtttgttacagaaagaaaatcatttttcgcatattctcaatacatatacagatgtaaaagaggtgattggcttttactctgaatcgactgatactaaattaatacaagataatgattccattcaaaagataaaacagttccttgacgcagttaaagacttacaggcttatgtaaaaccattattgggtaatagtgatgaaaccggtaaggatgaaagattttatggtgatttgattgagtattggagtctgcttgacttgattactcctttatataatatggttcgtaattatgtcactcagaagccgtattctgtagataaaataaaaataaatttccagaatcctactttattgaatggttgggaccttaataaagaaatggataatacatctgtgatattgcgtcgtgatggtaaatattatctggccataatgaataacaaatccagaaaagtctttttgaaatatccatcagggacagatagaaattgctatgagaagatggagtataaacttttacctggtgctaataagatgttacctaaggtcttcttttcaaaatcaaggataaatgaattcatgcctaatgagcgtttgttgtcaaattatgaaaagggcacgcataaaaagtcgggtacttgttttagtttggatgattgtcatactttgatagatttctttaaaaagtctttgaacaaacatgaggattggaagaattttggcttcaagttctctgatacttctacttatgaagatatgagtggtttttataaagaagtagagaatcaaggttataaattatcctttaaaccgattgatgctacgtatgtggatcagcttgttgatgaaggtaagatttttctgtttcagatttataacaaggatttttctgagcatagcaaaggtacgcctaatatgcataccttgtattggaaaatgttgtttgatgaaacaaatcttggggatgtggtatataaactaaatggtgaggctgaagtctttttccgtaaggcaagtataaatgtatcacatcccactcatccggctaacatacccataaagaaaaagaatcttaaacataaagatgaagaaagaattcttaaatatgacttgattaaagataagcgttatactgtcgaccagttccagtttcatgtaccaataaccatgaatttcaaggcgaatggaaatggaaatataaaccagaaagcgatagactatttacgttcggcatcagatactcatataatagggattgaccgtggtgaacgaaacttgttatatcttgtagtgattgatggaaatggaaaaatctgtgagcaattctctttaaatgaaatagaagttgaatataatggtgaaaagtattcaacaaattaccatgatttgcttaatgtcaaggagaatgaaagaaaacaggcaagacagagctggcaaagtatagctaacataaaagacttgaaagaaggctatttaagtcaggttattcataagatttctgaattgatggtcaaatataatgcgattgtggtgcttgaggatttgaatgctggatttatgcgtggccgacaaaaggttgaaaagcaggtttatcagaaatttgaaaagaaactcattgagaagttaaattatctcgtattcaagaaacagtcttctgatttgcctggtgggcttatgcatgcttatcagttagcgaataaatttgagagttttaatactttaggtaaacaaagcggatttctcttttatatccccgcctggaataccagtaaaatggatccggtaacaggttttgtaaatttgtttgatgtgaagtatgaaagtgttgataaagcaaaaagttttttcagtaagttcgattctataaggtataatgtggaaagagatatgtttgaatggaaattcaattatgatgaattcacgaaaaaagccgagggaaccaaaactgattggactgtttgttcctacggtaatcgaattatcacttttagaaatccggataaaaattctcaatgggataataaagaaataaatcttaccgaaaatattaagctgctgtttgaaaggtttggcatcgacttatcttcaaatctgaaagatgagataatggaacgtacagaaaaagaattctttatcgaactgatatccctatttaagcttgtgctacagatgcgtaatagttggacaggtactgatatagattatctggtatcacctgtatgcaatgaaaatggtgaatttttcgatagcagaaatgtagatgaaacacttccgcaaaatgcagacgcaaacggagcatataacattgcaagaaaaggaatgatacttcttgataagattaagaaaaataacggtgagaagaagcttactctgtctataactaatagagaatggctttcatttgctcaaggttgttgcaaaaatggatga

SEQ ID NO: 84 - DNA, 3738 bp, Artificial Sequence
  Description of Artificial Sequence: Synthetic polynucleotide
atggaaacatttagcggctttacgaatttgtaccctttatctaaaacgctgcgttttcgtttaatccccgtgggtgaaacgcttaaacacttcattggtagtggaattttggaggaggatcaacaccgcgcggaaagctacgtcaaagttaaagcgattatcgatgactatcaccgtacttacattgagaattccttatccgggtttgagttgcctctggagagcactggaaagtttaactctcttgaagagtactacctgtaccataatatccgtaacaaaacggaagagattcagaatctgtcctcaaaggtccgtacaaacttgcgtaaacaagttgtgacacagcttaccaaaaacgaaatttttaaacgtatcgataagaaggagttgattcaatcggatcttattgactttgtaaagaatgaacccgatgcgaacgagaaaattgcccttatctccgagttccgcaacttcacagtttacttcaaggggttccatgaaaatcgtcgtaatatgtattcagatgaagagaaatctacgtcaatcgcctttcgtttgatccacgaaaatttacctaaattcatcgataacatggaagtatttgctaagatccaaaacacgtcaatttcagagaatttcgacgctattcagaaggaattatgtccagaattagttactctgtgtgagatgtttaagttggggtatttcaacaagactttgtcgcagaaacagatcgatgcatacaatacggtcatcggaggcaaaactacgtcggaaggcaagaaaatcaagggtcttaacgaatacattaacttgtacaaccagcagcataaacaggaaaagttaccgaaaatgaagctgttattcaaacagatcttgtctgaccgtgaatctgctagctggttgttagaaaagtttgagaacgattctcaagtggtcggcgcgatggttaacttttggaatacaatccatgatactgtgctggcagaaggcggtttgaaaacaattattgcatcattgggctcttatggacttgaaggcattttcttaaaaaatgacctgcagttaaccgatatttcgcaaaaagctacaggaagctggtcaaaaatctcaagtgaaattaagcaaaaaatcgaagcgatgaatccacagaagaaaaaggagtcctacgaaagctaccaggagcgtatcgataaacttttcaagagctataagtccttctcgttggcattcgtgaatgagtgtctgcgtggagaatataaaatcgaagactattttctgaagttgggcgctgtgaatagtagtcttttgcaaaaagagaatcatttttcgcacattttaaatacgtacacagatgttaaggaagtaattggtttctactccgagtctactgacacaaagcttattcaggataacgatagcatccaaaagattaaacaatttttagacgctgtgaaggaccttcaggcatatgttaagcccctgcttggaaatagtgacgagacgggtaaagatgagcgtttttatggagatctgattgagtattggagccttttagatctgatcacacccttgtataacatggtacgtaactatgttacgcagaagccgtattccgtcgacaaaatcaagattaactttcaaaacccaacacttttaaacggatgggacttaaataaagaaatggataacactagcgtcatcttgcgtcgcgacgggaagtactacttggccattatgaataacaaatcgcgcaaagtatttcttaaatatccatctgggactgatcgtaattgttatgaaaagatggaatataaactgttgcccggggccaacaagatgttaccaaaagtgttttttagcaagtcccgcatcaatgagtttatgccgaatgagcgcctgcttagcaattacgagaagggcacgcataagaagtctggaacttgcttctcgttggacgactgccacactctgatcgactttttcaagaagtctttaaataagcatgaagactggaaaaactttgggtttaagttctccgacacctctacgtacgaagatatgtccggcttttacaaagaagttgaaaatcaaggctataagctttcgtttaaaccgattgatgccacgtatgtagatcaattggttgatgaaggaaagatctttctttttcagatctacaacaaggatttttccgagcatagcaaagggactccgaatatgcatacgttatactggaaaatgttgtttgacgagacaaatctgggggatgtggtatataaattaaacggtgaagccgaggtattcttccgcaaggcgtctatcaatgtatcacatccaacgcatcctgcaaacatcccgattaaaaaaaaaaatttgaagcacaaagacgaggaacgcatcttaaaatacgacttaattaaagacaaacgctacacagttgaccaattccaatttcacgtgccaatcacgatgaatttcaaagcgaatgggaatggtaatatcaatcagaaggcgatcgattatttgcgttcggcctccgatacccacattattggaattgatcgtggggagcgcaatttgttatatctggtcgtgattgacggaaatggaaaaatctgtgagcagttttccctgaacgagatcgaggtggaatacaacggcgagaaatatagtacgaactatcacgatttactgaacgtgaaggagaacgaacgcaagcaggcccgccaatcctggcaatccatcgccaatatcaaagacctgaaagaggggtatctttcgcaggtgattcacaagatttcggagttgatggtaaaatacaacgctatcgttgtgctggaagatctgaacgcgggttttatgcgtgggcgccagaaagtggaaaagcaggtgtatcagaaattcgagaaaaagcttatcgaaaagctgaattatttggtatttaagaaacagtcctcggaccttcctggcggtttaatgcatgcctaccaattggcgaataagttcgaatccttcaacactcttggaaagcagagcggatttttgttttacatcccggcttggaatacgtccaagatggatcccgtaacaggtttcgtgaatctgttcgacgtgaagtatgagagtgtggacaaggccaagagttttttcagcaagtttgatagcattcgctataacgttgaacgtgacatgtttgaatggaagtttaattacgatgaattcaccaaaaaagcagaaggtacgaaaacggattggacggtttgttcttacggcaaccgtattattacattccgcaaccctgataaaaactcacaatgggataataaagaaatcaatttaacagagaatattaagttgcttttcgaacgctttggaatcgatttaagttcgaaccttaaagacgaaattatggagcgcacggagaaggaattcttcattgagctgatttcgttgttcaagttggttcttcagatgcgtaactcgtggaccggcactgatattgactacttggtatcaccagtttgtaacgaaaacggtgaattctttgattcacgtaacgtggacgaaaccctgccccagaatgcggacgcaaacggcgcttacaacatcgcccgcaaaggcatgatcttattggacaagattaaaaaaaacaatggtgaaaagaagttaactttaagcattacaaaccgcgaatggctgagttttgctcaaggatgctgtaaaaatggctga

SEQ ID NO: 85 - DNA, 3738 bp, Artificial Sequence
  Description of Artificial Sequence: Synthetic polynucleotide
atggaaaccttttctggattcacaaatctgtatccacttagtaaaacgctgcgttttcgtcttattcctgtaggcgagacgcttaagcatttcatcggcagtggtattctggaagaggatcagcatcgtgcggaatcatatgtaaaagttaaagccattattgatgactaccatcgcacctatattgaaaacagtttgagtggctttgagttacccttggaatctacaggtaaatttaattcattagaggaatactatttgtatcataacattcgtaacaagaccgaagagatccaaaatcttagctctaaggtgcgtacaaatttacgcaagcaagtagttactcaattaaccaaaaacgagattttcaagcgcatcgacaagaaggaactgatccagtcagacttaatcgatttcgttaaaaatgagccggacgcaaatgagaaaattgctttgatttcagagtttcgcaacttcactgtgtattttaagggcttccatgaaaatcgccgcaacatgtactccgatgaggagaagagtacttctatcgcatttcgtttaattcatgaaaacttgcctaaatttattgacaatatggaagtgtttgcgaagatccaaaacacttcaatctctgagaactttgacgccatccagaaagagttgtgcccggaattagtcactctttgtgagatgttcaagttgggttatttcaataagactctgtctcaaaagcaaattgatgcctataatactgttattggtggaaagacgactagtgaaggcaagaagatcaaggggctgaacgagtacatcaatttatacaatcaacaacataagcaggaaaaattacccaaaatgaaattactgttcaagcagattttgtctgaccgtgaatcggcatcctggcttcttgaaaagttcgagaatgacagccaggtcgttggcgcaatggtaaacttttggaatacgatccacgatactgtacttgctgagggagggttaaaaacgattatcgcttcacttgggagttatggattggaggggatctttttaaaaaatgatctgcagttgacagacatctcgcaaaaggctaccggttcatggtcgaagatttctagcgagattaagcagaagattgaagctatgaacccccaaaagaagaaggaaagctacgagagttatcaggaacgcatcgataaactgtttaagtcctacaagagcttctccttggcattcgttaatgagtgcttacgtggtgaatataagattgaagactactttctgaagctgggagcagtcaacagctctctgttgcagaaggagaaccacttttcacatattctgaacacttacacggatgtaaaggaggtgattggcttttacagcgagtctaccgacacaaaattaattcaggacaatgattctattcaaaagatcaagcagtttttggatgcagtgaaagacctgcaggcatacgtcaagcctttgttaggcaacagtgatgagactggtaaagacgagcgcttttacggggatttaattgagtattggtccctgcttgacctgattacccctttatataatatggttcgtaattatgttacgcagaagccttactctgttgataagatcaagattaattttcaaaatccgacgcttttgaatgggtgggaccttaacaaggaaatggacaatacgtccgtgatcttgcgtcgtgatggtaaatactacttggccatcatgaataataaaagccgcaaggtctttttaaagtatccatcagggacggaccgtaattgctatgaaaaaatggagtataaattgttacctggtgcgaacaagatgcttccaaaagtatttttctcaaagtcacgtatcaacgagttcatgccaaatgagcgcttgttaagtaactatgagaaaggcacgcataaaaaatccggaacctgcttctccctggatgactgccacacattaattgacttttttaaaaagagtttaaataaacatgaagattggaaaaacttcggcttcaaattctccgacacttcaacgtacgaggacatgagtggattctacaaagaggtagaaaaccagggttataaactgtcctttaaacccatcgatgcgacatatgtcgaccagctggtagacgagggcaagatctttcttttccagatttacaacaaagattttagcgagcactccaagggaacgcccaatatgcacacgttgtattggaaaatgctttttgatgaaacgaacttaggagatgttgtctataaattgaatggagaggcggaggttttttttcgcaaagcgtcaattaacgtatcgcatcctacgcatccagccaacatccccattaaaaaaaaaaaccttaagcacaaagatgaggagcgcattcttaagtatgacctgattaaggataaacgttatacggtggaccagtttcagttccacgtgccgatcaccatgaattttaaagcaaacggcaacggtaatatcaatcagaaagcaatcgactacttacgctcggcctctgacacccacattatcggtatcgatcgcggggagcgtaacttgctttatctggtagtaatcgacggcaacggaaagatctgtgagcagttctcccttaacgagatcgaagtggaatataatggagaaaagtactctactaactatcacgacctgctgaacgtaaaagaaaacgagcgcaaacaagctcgtcagtcctggcagagcatcgctaacatcaaggatctgaaagaaggttacttatcgcaggtgatccacaagattagtgagttaatggtgaaatacaacgcaatcgtcgtacttgaggatttaaacgccggtttcatgcgtggacgccaaaaggtcgaaaaacaagtatatcagaaatttgaaaaaaagcttatcgagaaattgaattacttggtgttcaagaaacaatcaagtgatcttcccggcggtttaatgcacgcataccaattggccaacaagtttgagtcctttaatacgttgggtaaacagtcaggcttcttgttttatattccagcttggaatactagcaaaatggaccctgttacggggttcgttaacttattcgacgtgaagtacgaatcagtcgataaagctaaatcattctttagtaaatttgattcgattcgttacaatgtcgagcgcgatatgtttgaatggaagtttaattatgatgaattcacaaagaaggcggagggcacgaaaacggattggacggtctgctcctatggtaaccgtatcatcacatttcgtaacccggataaaaattcccaatgggataataaggaaattaacctgacggaaaatatcaaattactttttgagcgcttcggaattgacttatcttccaatttaaaagacgaaattatggagcgcaccgaaaaagaattctttatcgagctgatctcgctgttcaaactggtcctgcagatgcgcaatagctggactggaacagacattgattatttagtttcgccggtttgcaacgaaaacggagagttttttgacagtcgtaatgtggacgaaacacttcctcagaacgctgacgcaaatggggcatataatatcgcccgtaagggaatgatcttgttggacaaaattaaaaagaataacggggagaagaagcttacgttatccatcacaaaccgtgagtggttgagctttgcccaaggttgttgcaaaaacgggtga

SEQ ID NO: 86 - DNA, 3738 bp, Artificial Sequence
  Description of Artificial Sequence: Synthetic polynucleotide
atggaaaccttctcgggtttcaccaacttatacccccttagtaaaaccttgcgtttccgcttaattccggttggcgagactttgaagcacttcatcggaagcggaatccttgaggaggatcaacatcgtgcagaatcatacgtgaaagtaaaagctatcatcgatgactaccaccgtacttacattgaaaactctttaagcgggttcgaattaccccttgagtccacaggaaagtttaatagcttagaagagtactacctttaccacaatatccgcaacaaaacggaggaaattcaaaatttatcttcgaaagtccgcacaaatcttcgtaaacaggtcgtgacgcagttgacgaagaatgagatttttaaacgcattgacaagaaggaacttattcaaagcgatttaattgattttgttaaaaacgaaccggatgcaaacgaaaagatcgctttgatctccgaatttcgtaatttcacggtatactttaaagggtttcacgagaatcgccgcaacatgtattccgacgaagaaaagagtacatcaattgcattccgcttaatccacgaaaatctgccaaagtttattgacaatatggaagtattcgccaaaatccaaaacacgagcatcagcgagaattttgacgccattcagaaggagttgtgcccggagttagtaacgttgtgtgagatgtttaagcttgggtactttaataaaactctttcgcaaaagcagattgatgcatataacactgttatcggaggaaagacaacgagcgagggtaagaaaatcaaaggattgaacgaatacattaatttatataatcagcaacataagcaggagaagttgcccaagatgaaattactgtttaaacaaatcttatcagatcgtgagagtgcctcgtggctgttagagaaattcgagaatgatagccaggtcgtcggcgccatggttaatttctggaacacaattcatgacacagtattggctgaaggaggattaaaaactatcattgcgtctttaggaagttatgggcttgagggtatttttcttaaaaacgacctgcaactgaccgacatctcacagaaagctactggatcttggtcaaaaatcagctcggagattaagcaaaagattgaggctatgaatccacagaaaaaaaaggaatcgtatgagagctatcaggaacgcatcgataaactgttcaagtcctacaagtcgttctcattagcgtttgtaaacgaatgtttacgtggggagtataagattgaagattacttcctgaaacttggtgcggtcaatagttcgttgttgcagaaagagaatcatttctcgcatatccttaacacttacacggacgtcaaagaagttatcgggttctactcggaaagtacagacactaaattgatccaggacaatgactccatccagaaaattaagcagtttcttgacgctgtgaaagacttgcaggcttatgtaaaaccattgttggggaattcagatgagaccggcaaagatgagcgcttctatggcgacttaatcgaatactggtcgttgcttgatcttattacgccgctttacaacatggttcgcaactacgtcactcaaaaaccctattctgttgataagattaaaatcaatttccagaaccctacgttacttaatggatgggaccttaataaagaaatggacaacacttcggtaattcttcgccgcgacgggaagtattacttagcgattatgaacaacaagtcccgtaaagtattcctgaaatatccctccggtaccgaccgcaattgttacgagaagatggagtataaattattacccggagctaacaagatgctgccgaaggtcttcttctcaaaatcgcgcattaacgaatttatgcctaacgagcgtttgttatcaaactatgagaaaggaactcacaaaaagtccggcacttgcttttcgcttgatgactgccacacgcttatcgactttttcaagaaaagcttaaataagcacgaggactggaagaactttgggtttaagttctcggatacgagcacgtatgaggatatgagtgggttctataaggaagtggagaatcaaggttataaattatcctttaaaccaattgacgctacgtatgtcgatcagctggtagacgagggcaaaatcttcttattccaaatctacaacaaagatttttctgagcatagcaaaggaactccgaatatgcacaccctgtattggaaaatgctgtttgacgaaacgaatttaggcgacgtagtctacaagttgaacggtgaagcagaggtcttttttcgcaaagccagtatcaacgtatcgcaccctacgcacccggcgaatattcctatcaaaaaaaaaaatctgaagcacaaggatgaggagcgtattcttaaatacgacttgatcaaggacaaacgctacacggtggatcaattccagttccatgttccgattaccatgaattttaaggcaaatggcaacggtaatatcaatcaaaaagcgatcgattatcttcgttccgcatcagacactcatattatcggaatcgatcgcggtgaacgtaacttgctgtatctggtggtcattgacggtaatggtaaaatttgcgagcaatttagtctgaacgaaattgaagtcgagtataatggggaaaagtatagtaccaattatcatgatcttcttaacgtcaaggaaaatgagcgtaagcaagcacgtcaatcttggcaatcgattgctaatattaaggatctgaaagagggttacctgtcacaagtcatccacaagatttctgaacttatggtaaagtacaatgcgatcgtcgtcttggaggacctgaacgcgggtttcatgcgcggacgtcaaaaggtcgaaaagcaggtatatcaaaagttcgagaaaaagcttatcgaaaaacttaattatcttgtgttcaagaagcagagtagcgaccttcctgggggcttaatgcatgcataccagcttgccaataagttcgagtccttcaacacacttgggaaacaatctgggtttctgttttatattccggcgtggaatacgtccaaaatggacccagtcaccgggttcgtcaacttattcgacgtaaaatatgaaagcgtggataaggccaagtctttttttagtaaattcgattcaattcgttacaatgtcgagcgcgatatgttcgaatggaagtttaactacgacgagttcacaaaaaaggccgaaggaactaagacggactggacagtatgctcttatggtaatcgtatcatcaccttccgcaatcctgataagaattcccaatgggataataaagaaattaaccttaccgaaaatatcaagctgttgttcgagcgcttcgggatcgacctgagctctaacttgaaggacgaaatcatggagcgtactgagaaggaattttttattgagcttatctcgttatttaaacttgtattgcaaatgcgtaattcatggacaggaacggacattgattacctggtgagcccagtctgcaatgagaatggagagttcttcgactcccgcaacgtcgacgagacgctgccacaaaacgcggacgcgaacggggcatacaatatcgcccgtaaaggtatgatcctgctggacaaaattaaaaagaacaatggtgaaaaaaaattgacgctgagtattactaatcgtgagtggctttcgtttgcgcagggttgctgcaagaacggctga

SEQ ID NO: 87 - DNA, 3786 bp, Moraxella lacunata
atgttatttcaagactttactcatttatatcccctatcaaaaaccgtgcgttttgaattaaagcccattggcaagacattagagcatatccatgccaaaaactttttgagccaagataagaccatggcggacatgtaccaaaaggtgaaggcgatactggacgattatcatcgtgattttatcgctgatatgatgggcgaagttaagctaactaagctggcagaattttgtgatgtgtatttaaaatttagaaaaaatcccaaagacgatggattgcaaaaacagctaaaggacttgcaagcagttttaagaaaagagattgtgaagcccatcggtaatggcggaaaatacaaggtgggttatgaccgcttatttggggcaaagctctttaaggacggcaaagagcttggtgatttggcgaaatttgtcatcgcccaagagagcgagtcatcacccaagcttccccaaattgcccattttgagaagtttagcacctactttactggctttcatgacaaccgcaaaaacatgtacagcagtgatgataagcataccgccattgcctatcgtctgattcatgaaaatttgccacgttttatcgataatctacaaatattggcaaccatcaaacaaaagcattcggcattgtatgatcagattgcaagtgaactgactgcaagtggtttggatgtgtcgctagcaagtcatctgggcggctatcacaagcttttaacccaagagggtatcacggcttataataggataataggtgaagtgaatagttatacgaataagcataatcaaatttgccacaaatccgaacgtatcgccaaattacgccccctgcacaaacaaatcctaagcgacggcatgggcgtgtcgtttttgccaagcaaatttgccgatgatagcgagatgtgtcaagcggtcaatgagttttaccgccattatgctgatgtttttgctaaggtgcaaagcttatttgatagatttgatgactatcaaaaggacggcatttatgttgaacataaaaatctaaatgagctatctaagcgagcatttggtgattttgggtttttaaaacgattcttagaggagtattatgcagatgtgattgacccagagtttaatgagaaattcgccaagaccgagcctgatagcgacgaacaaaaaaaactggcaggagaaaaagacaaattcgttaaaggcgtacattccttggcaagtcttgaacaggtgattgagtattataccgctgggtatgatgatgagtctgtacaagcagacaaacttgggcagtatttcaaacaccgtctggcaggcgtggataatccaatccaaaaaatacacaacagtcacagtaccattaaggggtttttggagcgtgaacgtccagcaggcgagcgagcattgcccaaaattaagtcagataaaagtcctgaaatgacacaattaagacaactaaaagagctactagacaacgccttaaacgtggtgcattttgctaagctggtgtcgaccgaaaccgtattagacactcgaagtgataaattttatggcgaatttagacctttatatgttgagcttgccaagattaccacactttataacaaagtgcgtgattatctgtcgcaaaagccatttagcaccgaaaaatataaattaaactttggcaatccgacattattaaacggttgggatttgaataaagaaaaagataattttggggttatcttacaaaaagacggctgttattatttggcgttattggataaagctcataaaaaagtatttgataatgctccaaatacaggtaaaagcgtttatcaaaaaatggtttataagcaaatagcaaatgctcgacgggacttagcttgtttattgattattaatggtaaggtagttagaaaaacaaaaggattggatgatttacgtgagaaatatttaccatacgatatttataaaatttatcaatccgagagctataaggttttatcgccaaattttaatcatcaagacttggttaaatatattgattataacaaaattttagcatcgggatattttgagtattttgattttaggtttaaagaaagctctgaatataagagctataaagaatttttggatgatgtagataactgtggttataaaataagtttttgtaatataaacgccgattatattgatgagttggttgagcagggtcagttgtatttattccagatttataataaagatttctcgcccaaggctcacggtaagcccaatttgcatactttgtattttaaggcattatttagtgaagataatcttgccaatccgatttataagttaaatggcgaggcacagatattttatcgcaaggcgtctttggatatgaatgaaaccaccattcatcgtgcaggcgaggtattagaaaataaaaatcccgataatcccaaacagcgtcaatttgtctatgacatcatcaaagacaaacgttatacccaagataagtttatgctacatgtgcctattaccatgaattttggtgtgcagggcatgacgattgaaggatttaataaaaaagttaatcaaagcatacaacaatatgatgatgtgaatgtgattggcatagaccgtggcgagcgacatctgctatatctgaccgtgattaacagcaaaggtgaaatcttagaacagcgtagtctcaatgacatcatcaccacatcagcaaacggcacacaaatgaccacgccttatcataaaatcctaaataaaaagaaagaagggcgtttgcaggctcgtaaggattggggtgagattgaaaccattaaagagctaaaagcaggctatctaagccatgtggtacatcaaatcagccagcttatgcttaaatataatgccattgtggtgttggaagatttgaattttggatttaagcgtggtcgcctgaaagtggagaatcaggtttatcaaaactttgaaaacgccttaatcaaaaagctaaaccatttggtattaaaagataagacagatgatgagattggctcatataaaaatgccctgcaattgaccaataattttactgacctaaaaagcattggcaaacaaacgggatttttattctatgtgcctgcacggaataccagtaaaatagaccctgaaacgggctttgtggatttgttaaaaccacgttatgaaaatatcactcagtcgcaagcgttttttggtaaatttgataagatttgttataacacagataagggttattttgaatttcatattgattatgccaaattcactgacgaagccaaaaactctcgccaaacatgggtcatttgctcgcatggcgataaacgctatgtgtataacaaaaccgccaaccaaaataaaggggcgaccaagggtattaatgttaatgatgaattaaaatcgctatttgcttgtcatcacatcaatgacaaacagccaaatctggtcatggatatttgccaaaataacgataaagaatttcataaatcgctaatgtatctgttaaaggcattgcttgcattacgatatagtaacgccaatagcgatgaagattttattttatcgcctgtggcaaatgatgagggtgtgttttttaattcggcattggcggatgatacacagccacaaaatgcggacgccaatggggcatatcatatcgcattaaagggtttgtgggtactagaacaaatcaaaaacagcgatgatttggataaagttgatctcgaaattaaagatgacgaatggcgaaactttgctcaaaaccgctaa

SEQ ID NO: 88 - DNA, 3786 bp, Artificial Sequence
  Description of Artificial Sequence: Synthetic polynucleotide
atgttatttcaggactttactcatctttatccgctgtcaaaaacggtccgtttcgagctgaaaccgatcggtaagaccttagaacacattcatgcgaagaattttctttctcaagacaaaaccatggcagacatgtaccaaaaagttaaagctattttagatgattatcatcgtgacttcatcgcagacatgatgggcgaagtcaaattaacaaaacttgcggaattctgcgatgtatacttgaaattccgtaaaaatccaaaagatgacggtcttcaaaaacaattgaaagaccttcaagcagtgttacgtaaagagattgttaaacctattggtaacgggggcaagtacaaggtcggttatgaccgcttatttggcgcgaagttgtttaaggatggcaaagaattgggggacctggccaaatttgtgatcgcacaggagagcgagtcttctccgaaattgccgcaaatcgctcactttgagaagttctctacttactttacagggtttcacgacaatcgcaagaatatgtatagtagcgatgataagcacactgctattgcatatcgccttatccatgagaatcttccccgctttattgacaatctgcagatccttgcgacaatcaaacaaaaacattctgctttatacgaccagatcgcctcagagttaactgcgtctgggttagatgtgtcgctggcctcgcacctgggtggctaccacaaactgcttactcaggaaggtattactgcgtataaccgtatcattggcgaggtaaatagctatactaacaaacacaaccagatctgccataaaagtgaacgtattgccaagcttcgccccttacacaagcagatcctttcagacgggatgggcgtcagtttcttaccctctaagttcgcggatgactctgaaatgtgtcaggcagtcaacgaattctaccgtcactacgcagatgtgttcgctaaagtacaaagcttatttgatcgttttgatgattatcaaaaggacgggatttacgttgagcacaagaatttaaacgaattgtcgaagcgcgccttcggggatttcggctttttaaagcgctttctggaggagtactacgcagatgtgatcgatcctgagtttaacgaaaaatttgctaaaacggaacccgatagcgatgaacaaaagaagcttgcgggtgagaaagacaaatttgttaaaggtgttcattcgcttgcgagcttagaacaagtaatcgaatattatacagccggatacgacgatgagtctgtccaagcggataagcttggacaatatttcaaacatcgtcttgcaggcgtagataacccaatccaaaaaatccataattcacattccacgatcaagggtttcttggagcgtgaacgccctgccggggagcgcgcgctgcctaaaatcaaaagtgataaatcgcccgagatgacccaacttcgtcaacttaaggagttattggataacgcgttaaatgtggtccattttgcgaaattggtgagtacggagactgtacttgacacccgttccgacaagttttacggggagttccgcccgttgtatgtggagttggcgaagattactacactttacaataaggtacgcgattacttatctcaaaagccattttcaacggagaagtataagttgaacttcgggaatccaacgttgcttaacggctgggacctgaataaagaaaaagataacttcggggttattttacaaaaggacggttgctactacttggctttattggacaaggcacataagaaagtatttgacaacgcgccaaacacggggaagagtgtgtatcaaaaaatggtctataagcaaattgcaaatgcccgccgtgacttagcctgtttacttatcattaatggcaaggtggtccgcaaaacaaaagggctggacgacttgcgcgaaaaatatttaccctatgatatttataagatttaccaaagcgaaagctacaaagtactttccccgaactttaatcatcaggatcttgtgaagtatattgactataacaagatcttggcgagtgggtattttgagtattttgacttccgttttaaagagtctagtgagtacaaaagttataaggagtttcttgatgacgtagataattgtggctataagatctcattctgtaacatcaatgcggactatattgacgaattggttgaacagggacaactttatttattccaaatttataataaagatttcagcccaaaagcacacggtaagccgaatctgcacacgctgtactttaaagctctgttctctgaggataacctggccaaccccatttataagctgaacggggaggcccaaattttctaccgtaaggcgtccttggatatgaacgagacgaccattcaccgtgcaggtgaggttctggaaaataagaatccagacaacccaaaacagcgccaattcgtgtatgacattattaaagacaaacgctatacacaagataagtttatgttacatgtcccgattacgatgaacttcggtgtgcaaggaatgacaatcgagggttttaacaaaaaagtaaaccaatccatccaacaatacgatgatgtcaatgtaattggaattgatcgtggcgaacgccatctgctttaccttaccgtgatcaatagtaaaggagaaatcctggagcagcgtagtttgaacgatattattactacttctgcgaacgggacgcagatgaccacaccttaccataagattttgaataagaaaaaagaagggcgtttgcaagcgcgtaaggactggggggagatcgagaccattaaagagctgaaagcggggtatttgagtcacgtggtacatcaaattagtcaattgatgcttaaatacaacgctattgtcgtacttgaggaccttaacttcgggttcaaacgcggccgcttaaaggtagagaatcaggtgtatcaaaactttgaaaacgccctgattaagaaactgaatcacctggttcttaaagataagaccgatgatgagattggatcatataaaaacgcattacaactgaccaataattttacggacctgaagtctattggcaaacagactggctttcttttctacgttccggcgcgtaacacgagtaagattgaccccgagactggtttcgttgatttgttgaagcctcgttacgagaacatcacacagtctcaggcttttttcggaaaatttgataaaatttgttacaatacagacaagggctatttcgaatttcacatcgattatgcaaagttcactgatgaggcaaaaaattcgcgccaaacatgggtgatctgctcgcacggagacaaacgttacgtatacaacaagacagcaaaccagaataagggggccactaagggaattaacgtcaacgacgagctgaaatcgcttttcgcttgtcatcacattaacgataagcaaccaaatttggttatggacatctgtcagaacaatgacaaggagtttcataaatcgctgatgtacttgcttaaagctttgttggctttacgttacagcaatgctaactcagatgaagacttcatcttgtcgccggtagctaacgatgagggcgtcttctttaacagcgctctggcagatgacacgcaacctcagaacgcagacgctaacggggcgtatcatattgctctgaaaggactgtgggttttagagcagattaagaattctgacgatttagacaaggtggatttggaaattaaggatgatgaatggcgcaactttgcccaaaaccgttaa

SEQ ID NO: 89 - DNA, 3786 bp, Artificial Sequence
  Description of Artificial Sequence: Synthetic polynucleotide
atgttgtttcaggatttcacgcacctgtatccattgtcgaagacggttcgtttcgagcttaaaccaattgggaagactctggagcatatccacgcgaagaatttcttgagccaagataagaccatggcagatatgtaccaaaaagttaaagctatccttgacgactaccatcgcgatttcattgcagacatgatgggagaggtcaagcttaccaagctggcggagttttgcgatgtctacttgaagtttcgtaagaacccgaaggatgacggtcttcaaaagcagttaaaagatttgcaagcggtgttacgtaaagaaattgtcaagccgatcggcaatggtggcaagtataaggttgggtatgatcgtctgtttggtgctaaactttttaaagacggaaaggagttgggagaccttgccaagtttgtaatcgctcaggaatcagagagttcgccaaagcttcctcaaattgcgcatttcgagaagttcagtacctatttcactggttttcatgacaatcgcaagaatatgtactcatcagatgacaagcataccgcaatcgcataccgtttaattcatgaaaatctgccacgcttcatcgataaccttcagatcttagctacaatcaaacaaaaacactccgcactttacgaccagatcgcctccgaattgaccgcaagtggtctggacgtgagcctggcttcccacttggggggataccacaaacttctgacccaagagggtatcacagcgtataatcgcattattggtgaagtaaactcctatactaacaaacacaaccaaatctgtcataaaagcgagcgtattgcgaagttacgccccctgcacaaacaaattctgagcgacggaatgggtgtaagtttcctgccttctaaattcgcagacgatagtgagatgtgccaggcggtcaacgagttctaccgccactacgccgatgtatttgcgaaagttcaaagcctgttcgaccgtttcgatgactaccaaaaggacggcatctacgtggagcataaaaacttgaacgaattatcgaaacgcgcatttggcgatttcggcttcttaaagcgcttcctggaggagtactatgctgatgtaattgacccggagttcaacgagaaatttgcaaagaccgaacctgactctgacgagcagaaaaagttagccggcgagaaggacaaatttgtaaaaggagtgcatagcttggcctcattagaacaagtaatcgagtactatactgctgggtatgatgatgaaagcgttcaggcggataaacttggtcaatactttaaacatcgccttgccggcgtggataacccgattcaaaagattcataactcgcattcaacaatcaagggctttcttgaacgcgaacgcccagctggtgagcgcgccttgccgaagattaagagcgacaaaagcccggagatgactcaattgcgtcagctgaaggagttgctggataatgcccttaatgtggtccatttcgcaaagctggtctcgacggagactgtacttgacacccgttcggacaagttctacggcgagtttcgccctctttacgtggagctggctaaaatcactacattatacaacaaggtgcgcgattacttaagccaaaagccgtttagtacggaaaaatataagttaaacttcggtaacccgaccttgttaaatggatgggacctgaataaagaaaaagacaacttcggcgtgattttgcaaaaagatggttgttactatttagcgttactggataaagcacacaaaaaggttttcgataacgcgcccaacaccggcaaatcagtgtaccagaaaatggtctataagcaaattgcaaatgcccgccgtgacttggcgtgcttattgatcattaatggtaaggtggtacgtaagaccaaggggcttgatgatctgcgtgagaaatatttaccatatgacatctacaaaatttatcaaagcgagagttacaaagttttatcccccaattttaatcatcaggatcttgtcaagtatatcgactataataaaattctggcttcgggatacttcgagtacttcgatttccgctttaaggaatctagcgagtacaaatcgtataaagagttcttagatgatgttgataattgcggatataaaatttcgttttgcaatatcaacgcagattatatcgatgaactggtagagcaagggcagctgtatttgttccaaatttataacaaagactttagtccaaaggcccacggaaagccaaatctgcacactttatattttaaggcgcttttcagtgaagataacttagcgaatcctatttacaagttaaacggcgaggctcagatcttctatcgcaaggcgagccttgatatgaacgagacaacgattcaccgtgcgggcgaagtgttagaaaataaaaacccagataatccaaagcaacgccagtttgtgtatgatatcattaaagacaaacgttacacacaagataagttcatgctgcacgtccccattactatgaactttggtgtgcagggaatgacaattgagggcttcaacaaaaaagtgaaccaatcaattcagcagtacgatgatgtgaatgtcatcgggattgaccgtggggagcgccaccttttgtacctgactgtcatcaactccaagggtgagattttagaacaacgcagcctgaacgatatcattactacctctgccaatggtacccagatgaccacgccttatcacaaaatcttgaacaagaaaaaagagggccgtttgcaggcgcgtaaggactggggagaaattgagaccatcaaagaacttaaggccggatatctttcccatgtggtccatcaaattagccagttgatgctgaaatacaacgccatcgtggtgttggaggatttgaactttggatttaaacgcgggcgtctgaaggtcgagaatcaagtataccaaaactttgagaatgctcttatcaaaaagttgaatcatttagtactgaaggataaaacggacgatgaaattggtagttacaaaaatgccttgcagcttactaacaactttaccgacttaaaaagcatcggtaaacaaactggattcttattctatgtacctgctcgtaacacgtcaaaaatcgacccggaaaccggctttgtcgatttgcttaagccccgttacgagaacatcactcaatcccaggcatttttcggcaaatttgacaagatctgctacaacacggacaaggggtattttgagtttcacattgactatgcaaaatttacggatgaagctaagaacagtcgtcagacttgggtaatctgctcacacggagacaaacgctatgtatataataaaaccgctaatcagaacaagggtgccacaaaaggtatcaacgtgaacgacgagcttaaaagcttattcgcgtgccatcacattaacgacaaacaacccaacttagtcatggatatctgtcagaataatgataaggagttccacaagagcttaatgtacctgttgaaggcgcttctggcgttacgctactcaaatgcaaattcagacgaagacttcattctgtcgcctgtagctaacgatgaaggtgtcttttttaattctgctttggcagatgacacacagccgcaaaatgcggatgcgaacggagcatatcacattgcgttgaagggtctttgggtcttggagcaaatcaagaattctgacgacttggataaggtagatcttgaaatcaaggacgatgaatggcgtaattttgcacagaatcgttaa

SEQ ID NO: 90 - DNA, 3786 bp, Artificial Sequence
  Description of Artificial Sequence: Synthetic polynucleotide
atgcttttccaagactttactcacctttacccactttcaaaaacagtacgtttcgaattaaagcctattggcaagacgttagagcacatccatgcaaagaactttttatcgcaagataagacaatggccgatatgtatcagaaagtcaaggcaatcttggatgattatcaccgtgattttatcgctgatatgatgggcgaagttaaattaactaaacttgcagagttttgtgacgtctatttaaaatttcgcaaaaacccgaaagacgatgggttgcagaagcaacttaaagatctgcaggcggtactgcgcaaggaaattgtaaagcccattgggaacggcgggaagtacaaagtggggtatgatcgcctgttcggcgcgaaacttttcaaagacggaaaagaattgggcgatctggctaaatttgttattgctcaagaaagcgagagctcgccgaaattacctcaaattgcgcatttcgaaaaattcagcacgtattttacaggctttcacgataatcgcaagaatatgtattcgtctgacgacaaacacacggcgatcgcgtaccgcttaattcacgaaaatctgcctcgcttcattgacaatcttcaaattcttgcgacaatcaaacagaagcactctgctttatacgaccaaattgctagcgagcttacagcctctggtttggacgtctcacttgctagccatcttggaggttatcacaagttgttgacccaggaagggattacggcctataaccgcattattggagaagtcaactcgtacacgaacaagcacaaccaaatctgtcataaaagtgaacgcattgcaaaattgcgtccgcttcacaaacagattcttagtgatggaatgggggtgtcatttctgccgtcaaagttcgcggatgatagtgaaatgtgtcaggctgtgaatgaattctaccgtcattacgcggacgtattcgccaaggtgcagtcattatttgatcgctttgatgactatcagaaggacggtatttatgtggagcacaaaaatctgaacgaattatccaaacgcgcattcggggacttcgggtttttgaagcgtttccttgaagagtactacgccgatgtcatcgacccagagttcaatgaaaagtttgcgaaaacagaaccagatagtgacgaacaaaagaagctggcaggtgagaaagacaaattcgtcaagggagtgcattctctggcttcattagagcaggttattgaatactacacggcgggctatgacgacgagtcggtgcaggccgataagttagggcagtacttcaagcaccgtttagctggggtcgataatcccatccagaagattcacaattcccacagcacgatcaaaggcttcctggaacgtgagcgccccgcgggcgagcgtgctctgcctaaaattaaaagtgacaagtctccagagatgacccagttacgtcagctgaaagagttattagacaacgcactgaacgtagtacacttcgcaaaactggtatcaacagagacagtcctggatacgcgctcggacaagttttatggtgagttccgccccttgtacgtcgagttggcgaagatcacaacactgtataacaaagttcgtgactatctgtctcaaaagccgttttccacagaaaagtacaagcttaatttcggaaatcctacacttctgaatggctgggacttaaacaaagagaaggacaactttggagtcattcttcaaaaagatgggtgttactacctggcgcttctggacaaggcccataaaaaggtgtttgacaatgccccaaacacaggcaagtctgtctatcagaaaatggtctacaagcaaattgccaacgcccgccgcgacctggcatgtctgcttattatcaacggcaaggttgttcgtaaaacaaaggggctggacgatttgcgcgaaaaatatctgccatacgacatttataagatttatcaatcagaatcttacaaagtcctttccccaaacttcaaccatcaggacttagttaagtatatcgattataataagatcttagcaagtgggtacttcgaatactttgactttcgctttaaagaatccagcgagtacaagagctataaggaatttcttgatgacgttgacaactgtggctataaaatttcgttttgtaacattaatgcggattacattgatgaacttgtagaacaggggcaattgtatcttttccaaatctacaataaagattttagtcccaaggcgcatggaaagccaaacttacataccttatatttcaaagcacttttttccgaggacaacttggctaacccaatttataagcttaacggggaagcgcagatcttttaccgcaaagcaagtttagatatgaacgaaaccacgattcaccgtgccggagaggtcctggaaaacaaaaatccagacaatccgaaacagcgccaattcgtgtatgatatcatcaaagacaagcgttacacgcaggacaaatttatgttacatgttccaatcaccatgaactttggcgtacaaggcatgaccatcgagggatttaataagaaggtcaatcaatcaattcagcaatatgacgatgtcaatgtaatcgggatcgatcgtggagagcgccacctgctgtacctgactgtcatcaactcaaagggtgagatcttagagcagcgttcgttgaatgacatcattaccacatcagctaatggtacccaaatgaccacaccataccacaaaatcctgaataaaaagaaagaaggccgcttgcaggcgcgtaaagattggggcgagattgaaacgattaaggaactgaaagcaggttacttgtctcatgttgtacatcaaatttcacaactgatgttgaaatataatgcgattgttgtattggaggatttgaatttcggatttaagcgcggacgccttaaagttgagaatcaagtgtaccaaaacttcgagaacgccttgatcaaaaagcttaaccatttggtgcttaaggataagacagacgatgagattggcagttataaaaatgcattgcagcttacgaacaactttaccgacctgaaatctattgggaaacaaacgggttttttattttatgtgccggcgcgcaacacgtccaaaattgatccggagacaggatttgtcgatcttcttaaaccccgttacgaaaatatcacccagtcgcaagcctttttcggcaaattcgataagatttgttataacacagacaagggatactttgaattccacattgactacgcaaagtttaccgatgaagccaaaaactcacgtcaaacatgggtcatttgcagtcacggtgataagcgttacgtttataataagaccgccaatcagaataaaggtgcaacgaaaggtatcaacgtaaatgatgaacttaagagccttttcgcctgccaccatattaacgacaagcaaccgaatttagttatggacatctgtcaaaacaatgataaagaatttcataaatctctgatgtatttgcttaaggcgctgttagcccttcgttattctaatgcaaacagcgacgaggatttcattctgtccccagtggcaaacgatgagggggtgtttttcaattcggccttggccgatgacacccagccccaaaacgcggatgcaaacggggcgtaccacattgcgctgaagggcctttgggtattagagcaaatcaagaactccgatgacttagataaagtggacctggaaatcaaggacgatgagtggcgtaattttgcacagaatcgctaa

SEQ ID NO: 91 - DNA, 3828 bp, Unknown
  Description of Unknown: Lachnospiraceae bacterium sequence
atgggtaaaaatcaaaattttcaggaatttattggggtatcaccacttcaaaagactttaagaaacgaattgatcccaacagaaacaacaaaaaagaatattactcagcttgatcttttgacggaggatgaaatccgtgcgcaaaatcgagagaagctgaaagagatgatggatgactactaccgggatgtgattgatagcactttgcatgcgggtatagctgttgattggagctatttattttcgtgtatgcgaaatcatctaagggagaattccaaagagtcaaagcgggaattggaacgaacacaggattctattcgttcacaaatctataataagtttgctgaacgagcggattttaaggatatgtttggagcatcgataataacaaaattacttccgacatatataaaacagaatccagaatattccgagcggtatgacgagagcatggaaattttgaaactgtatggaaaattcacaacatcgttgaccgattactttgagacaagaaagaatatcttttctaaagagaaaatatcttctgccgttggatatcgaatcgtagaggaaaatgctgagatcttcttgcagaatcagaatgcttacgacagaatctgtaagatagcgggactggatttacatggattggataatgaaataacagcatatgttgatggaaaaacattaaaagaagtatgttcggatgaaggatttgcaaaggctattacacaagaagggattgatcgctacaacgaggcaatcggtgcagtaaatcaatatatgaatctgttatgccagaagaataaggcattaaaaccgggacaatttaagatgaagcggttacataaacagattctttgcaaaggaacaacctctttcgatattccaaagaaatttgaaaatgataaacaggtgtatgacgcagttaattcttttacagagatagtaatgaagaataatgatttgaagcgactgttaaatattacacagaatgtaaatgattatgacatgaataaaatctatgtagcagccgatgcatatagtacgatttcacagtttatcagtaaaaaatggaatctgattgaagaatgtttgctggattattatagcgataatttgccgggaaaaggaaatgcgaaagaaaacaaagttaaaaaggcggtaaaggaagaaacgtatcgcagtgtttcacagttgaatgaacttattgagaaatattatgtggaaaagacaggacagtcagtatggaaagtggaaagttatatttcgaggctggcagaaacgattacattggaattgtgtcatgagatagaaaacgatgagaagcataatctgattgaagatgatgacaagatatccaagatcaaggaactgttggatatgtacatggatgcatttcatattataaaagtgttccgggtgaatgaagtattgaatttcgatgaaaccttttattcggagatggatgagatttatcaggatatgcaggaaatcgttccattatacaatcatgttcgaaactatgttacacagaaaccatataaacaggagaaatatcgtttatatttcaacactccaacattggcaaatggctggtccaagaataaggaatatgataacaacgctattatcttaatgcgagatgataaatattatttaggtattctgaatgcaaaaaagaaaccatcgaaacaaactatggcgggcaaagaggactgtttagaacatgcgtatgcaaagatgaattattatttgttgccgggtgcgaacaagatgcttccaaaagtatttttatctaagaaaggaatacaggactatcacccatcatcatatattgttgaaggatataatgaaaagaaacatattaaaggttccaagaattttgatatccggttttgtagggatttgattgactacttcaaggaatgcattaaaaaacatccggattggaataagtttaactttgaattttctgcgacagaaacatatgaggatatcagtgtcttttatcgcgaagttgaaaagcaaggatatcgcgtagagtggacgtatatcaatagtgaagatattcagaaactggaagaagatggacagttgtttttatttcagatatataacaaagattttgctgtgggaagtacaggtaaaccaaatcttcatacattgtatctgaaaaatctgttcagcgaagaaaatttgcgggacattgtattaaaactaaatggggaagcagaaatattcttccgtaaatcaagtgttcaaaaaccggtgattcataagtgcggcagtattttagtcaatcgtacctatgagattaccgagagtggaacaacacgggtacaatcaattccggaaagtgaatacatggaattatatcgctactttaatagtgaaaagcagatagaattatcagatgaggcaaaaaaatatttggacaaggtgcaatgtaataaggcaaagacagatattgtgaaagactaccgatacaccatggacaagttttttattcatcttccgattacgattaattttaaggttgataagggtaacaatgttaatgccattgcacagcaatatattgcagagcaggaagatttgcatgtgataggaatcgatagaggagaacggaatctgatttacgtttctgtaattgacatgtatggcagaattttagagcagaaatcctttaaccttgtggaacaggtatcgtcgcagggaacgaagcgatattacgattacaaagaaaaattacagaaccgggaagaggaacgggataaagcaagaaagagttggaagacaatcggcaagattaaggaattaaaagaggggtatctgtcgtcagtaattcatgagattgcacagatggtcgtaaagtataacgcaatcattgcaatggaagatttgaattatggatttaagcggggaagattcaaagtagagcgccaggtatatcagaaatttgaaacgatgttgatcagtaagttgaattatctggcagataaatctcaggctgtggatgaaccgggaggtatattacggggatatcagatgacttatgtgccggataatattaagaatgttggaagacaatgtggaataatcttttatgtgccggcagcatatacctccaagattgatccgacaaccggatttatcaatgcatttaagcgggatgtggtatcaacaaatgatgcaaaagagaatttcttgatgaagtttgattctattcagtacgatatagaaaaaggcttatttaagttttcatttgattacaaaaattttgccacacataaacttacacttgcgaagacaaaatgggacgtatatacaaatggaactcgaatacaaaacatgaaagttgaaggacattggctttcaatggaagttgaacttacaacgaaaatgaaagagttgctggatgactcgcatattccatatgaagaaggacagaatatattggatgatttgcgggagatgaaagatataacaaccattgtgaatggtatattggaaatcttctggttgacagtccagcttcggaatagcaggatagataatccggattacgatagaattatctcaccggtactgaataatgatggagaattttttgattctgatgaatataattcatatattgatgcgcaaaaggcaccgttaccgatagatgccgatgcaaatggcgcattttgcattgcattaaaaggaatgtatactgccaatcagatcaaagaaaactgggttgaaggggagaaacttccggcggattgcttgaagatcgaacatgcgagttggttagcatttatgcaaggagaaaggggatag

SEQ ID NO: 92 - DNA, 3828 bp, Artificial Sequence
  Description of Artificial Sequence: Synthetic polynucleotide
atgggtaagaatcaaaactttcaagaattcattggcgtttctcctttacaaaaaactttacgtaatgaactgattcccacggaaaccacgaagaaaaacatcacccagcttgacttattaacagaggacgaaattcgtgctcaaaatcgtgaaaagcttaaggagatgatggacgattactatcgcgacgtaatcgactctacgttacatgcaggcatcgccgtcgattggtcgtacttatttagttgtatgcgtaatcatttgcgcgagaatagcaaggaatcgaagcgcgagctggaacgcacgcaggacagcattcgctcacaaatctacaacaaattcgcagaacgcgctgactttaaggatatgttcggtgccagtattattaccaaattactgcctacgtacattaaacaaaatccagagtacagtgaacgttacgatgagtctatggaaatccttaagctgtatggtaaattcactacatcacttactgattatttcgaaacacgcaaaaacattttcagtaaagagaagatctcaagtgccgtggggtaccgcattgttgaagagaatgcggaaatcttcttacaaaaccaaaatgcgtacgatcgcatctgtaaaattgccggattggacctgcatggcttagataatgagatcacagcctatgtggacggtaaaacgctgaaagaggtttgctcggatgagggtttcgcgaaggcgatcacccaagaaggcatcgaccgttataacgaggccatcggggcagtcaatcaatatatgaatctgctgtgtcagaagaataaggcgcttaagcccgggcaattcaaaatgaagcgtttgcataagcaaatcctttgcaaaggtactacgagtttcgacattccgaagaagttcgagaacgacaagcaagtgtacgacgcagttaattcgtttacagaaatcgttatgaaaaacaacgatttaaagcgccttttaaatattactcaaaacgtcaatgattatgacatgaataagatttacgttgctgcagatgcgtactctacaatctctcagttcatctccaagaaatggaatttgatcgaggaatgtttgttggactactacagcgataacttgcccggcaagggaaacgcgaaggagaacaaagtaaagaaggcggtgaaagaagaaacttatcgtagtgtgtcacagcttaatgagttgatcgagaagtattacgtagaaaaaaccggtcaaagcgtatggaaggtggagagttacatttctcgtttggccgaaacaattaccctggagctgtgtcatgaaattgaaaacgatgaaaaacacaatctgattgaagatgatgacaaaattagcaaaatcaaagagctgctggatatgtacatggatgcgttccatattatcaaggtttttcgcgtcaacgaagtactgaattttgatgaaactttttactccgaaatggacgaaatttatcaggacatgcaagagattgtccctctttataaccatgttcgtaactacgtgacgcagaagccatacaaacaagagaaatatcgcctgtattttaatacgcctacgttagcaaatgggtggtcaaaaaacaaggaatatgataacaatgctatcattcttatgcgtgatgataaatactatctgggtattttgaatgccaaaaagaaaccatccaagcaaacaatggccggtaaagaggactgcctggagcatgcatatgcgaagatgaactattatcttttaccgggcgctaataaaatgctgccgaaggtattcctgagtaagaaaggtattcaagactatcatcccagttcctacattgttgaaggttataacgagaagaaacacattaaaggttcgaagaattttgacatccgcttctgtcgcgacttaattgactacttcaaagaatgcatcaagaagcaccccgactggaataaatttaattttgagttcagtgccactgaaacgtatgaagacatttccgtgttctaccgcgaggtggaaaagcaagggtatcgcgtcgaatggacgtatattaactcggaagatattcagaagctggaagaagacggacagttattcctttttcagatctataataaagatttcgccgtaggttcgacaggtaagcccaaccttcacaccttgtacttaaagaatttgttttctgaagagaacctgcgtgacatcgtcttgaagctgaatggcgaggctgaaatcttttttcgtaagtcctcagttcaaaagccggttatccataagtgcggcagtattttagttaaccgcacgtatgaaattacggagagtggcaccacccgcgtccagtcaattccggaaagtgagtatatggaattgtaccgctattttaattcagaaaaacaaatcgagctttcagacgaagcgaagaaataccttgataaggtccagtgtaataaagccaagacggatattgtaaaggattatcgttacactatggataagtttttcattcatcttccaatcacgattaatttcaaagttgataagggcaacaacgtgaatgcaattgcccaacagtacattgccgaacaggaggaccttcacgttatcgggattgaccgtggagaacgcaacttaatttacgtctctgtcattgacatgtatggccgtattttggaacagaaatcatttaacttagtcgagcaagtgtcttcgcagggcaccaaacgctattatgattacaaagagaagttgcaaaaccgcgaggaagaacgcgataaggctcgtaaatcatggaagacaatcgggaagatcaaggaattgaaagaaggctacctgtcgagtgtgattcacgagattgcccagatggtggtcaaatacaacgcgattattgcaatggaggaccttaactatggattcaaacgcgggcgttttaaggtggaacgccaagtttatcaaaagtttgaaacaatgcttatctctaaattaaactatttagcagataagagtcaagccgtggacgagcccggtggcatcttgcgcggataccagatgacttacgtgccggataacatcaaaaacgtgggccgccaatgtggcattatcttttacgtgccggccgcctacacttccaagatcgatcctaccacggggtttattaatgcatttaagcgcgacgtggtatcaacaaatgacgcaaaggaaaactttctgatgaagtttgacagcatccagtacgacatcgagaagggattatttaaattctctttcgactataaaaattttgctacccacaaactgacccttgcgaagacgaagtgggatgtatatactaacgggacccgcattcagaacatgaaggttgaaggacactggctttcgatggaggtcgagcttaccactaagatgaaggagttattggacgacagtcatattccttatgaggagggtcagaacattttagacgatctgcgcgagatgaaagacatcacgacgatcgtgaacggaattttggaaatcttctggttgactgtgcaacttcgtaactcgcgcattgacaatcccgactacgaccgcattatctcgcccgtgctgaataacgatggggaatttttcgactcagacgaatataattcctatatcgacgcgcagaaagcgccactgcctatcgacgccgatgcgaatggagcgttttgcattgccttgaaggggatgtacacggcaaatcagatcaaagagaactgggttgaaggagagaaattaccggctgattgcctgaagatcgagcatgcctcttggttggcgtttatgcagggtgagcgtggctag

SEQ ID NO: 93 - DNA, 3828 bp, Artificial Sequence
  Description of Artificial Sequence: Synthetic polynucleotide
atgggtaaaaaccaaaattttcaggagttcatcggtgtaagcccccttcagaaaactcttcgcaatgaactgattcccactgaaactacgaagaagaatattacacagttggatctgttgaccgaggacgaaattcgcgcacagaatcgtgaaaaacttaaggaaatgatggacgactactatcgcgacgtgattgatagtacactgcacgcgggcattgctgtcgactggagctaccttttttcgtgcatgcgcaaccacctgcgcgaaaattctaaggaaagtaaacgtgagcttgagcgtacacaggactctattcgttcccaaatttacaacaaatttgcagagcgtgcggatttcaaagacatgttcggcgcctcaatcattactaaattactgcccacctatattaagcaaaatcctgagtattctgagcgctacgatgagtctatggaaatccttaaactgtatggaaagtttacaacatcattaacggattattttgaaacgcgtaagaacatttttagtaaagaaaagatctccagcgccgtcggctaccgtattgtcgaggaaaacgctgagatctttttgcaaaaccaaaacgcatatgatcgtatttgcaaaattgctgggcttgaccttcatgggttggacaacgagatcacagcatatgtggatgggaaaacgctgaaggaagtctgtagtgatgagggcttcgcaaaagcgatcactcaggaaggtattgatcgctacaatgaggcaattggcgcggttaaccaatacatgaatttactttgtcagaaaaacaaagcgttgaagcctggtcagtttaagatgaagcgtcttcataaacagattttatgcaagggtaccacgtcctttgatatcccgaaaaagttcgaaaacgacaaacaagtgtatgacgccgtcaatagctttacggagatcgtaatgaaaaataacgatctgaagcgtcttttgaatattacacagaatgtgaatgactatgatatgaacaaaatttacgtagccgcagatgcgtattctacgatcagtcagttcattagcaaaaagtggaacttaatcgaagaatgccttcttgactactatagtgataaccttccaggcaaaggaaacgctaaggaaaataaggtgaagaaggccgtgaaggaagaaacgtatcgtagtgtctcacagttgaacgaattgatcgagaagtattatgtggaaaagactggacagtcggtgtggaaggttgagtcatacatctcgcgcttagcagagaccattactcttgagttgtgtcatgagattgagaacgatgaaaaacacaatttaatcgaggatgacgacaaaatttcgaaaatcaaggaattattggatatgtatatggacgcatttcacatcatcaaggttttccgtgttaacgaagtattaaatttcgacgagactttttattccgaaatggatgagatttaccaggatatgcaagaaatcgtgcctttgtataaccacgttcgcaactacgtaacccaaaagccatacaaacaagagaagtatcgtttgtatttcaacacgccaactcttgcaaacggttggtcgaaaaataaggagtacgataacaatgccatcattctgatgcgcgatgacaagtactacttaggtatcttaaatgcgaaaaagaagccttcgaaacaaactatggccgggaaggaagattgcttagagcatgcttatgctaagatgaactactacttgttgccaggggctaataagatgctgcctaaagtctttctgtcgaagaaggggattcaggactaccatccgtcatcgtatattgtggagggctacaacgagaagaaacacatcaaaggttctaagaattttgatattcgcttctgccgcgatttgattgactacttcaaggaatgcatcaaaaagcatccagattggaacaaatttaacttcgaattttccgccactgaaacctatgaagatatctccgtattttaccgcgaggtcgaaaagcagggttaccgcgtagagtggacatatattaattcagaagacattcagaaattagaagaggatggtcagttgtttctgtttcagatctataacaaggatttcgcggtcgggtccactgggaagcctaatttgcatacgctttatttaaaaaacttatttagtgaagaaaacctgcgtgacattgtactgaaacttaatggtgaagcagaaatttttttccgcaagtcgtccgtccagaaacctgttatccataagtgcggtagtatcctggtcaatcgcacttatgaaattacggagagtggcacgactcgcgtgcagtcaattccagagtcggaatacatggagctgtaccgttatttcaactctgagaaacaaatcgagctgtctgacgaggcaaagaagtatcttgacaaggttcaatgtaacaaggctaagacggacatcgtgaaagattaccgctataccatggacaaattttttattcatctgcccatcactatcaactttaaggttgacaaaggtaacaatgtgaatgcaattgcgcaacaatacatcgccgagcaagaggacttacacgtcattggaattgatcgtggggaacgtaacttgatctacgtgagcgtcatcgatatgtacggtcgtattttagaacaaaaatcatttaatttggtcgaacaagtttcatctcaaggaacgaagcgctactacgattataaggaaaaacttcaaaaccgtgaggaagagcgcgataaggcacgcaagtcgtggaagacaattggcaagatcaaggaattgaaggagggctatctgagcagcgtgattcatgaaattgcccaaatggttgtcaaatacaacgcgatcattgcgatggaagatctgaactatggatttaagcgtgggcgctttaaagtagaacgtcaggtgtatcagaagtttgagacaatgctgattagcaaattaaattatctggccgacaagagccaagcagttgacgaacctggcggtattttacgcggttatcaaatgacctacgtgcccgacaacatcaaaaacgtgggacgccaatgtgggattatcttctacgtcccagcggcctatacatctaaaatcgacccgacaactggatttattaacgcgtttaaacgtgatgttgtttctacaaatgatgccaaagaaaacttccttatgaaattcgactccatccaatacgatattgagaaaggccttttcaagttcagcttcgactacaagaacttcgcaacgcataagcttacccttgctaaaactaagtgggatgtatatacgaacgggacccgtattcagaatatgaaagtcgaggggcattggctgtcaatggaagtagaacttaccacaaagatgaaagaattactggacgactctcatatcccgtacgaagaaggtcagaatatcctggatgatcttcgcgagatgaaagacatcacaactattgtgaacggcattttagaaattttttggctgaccgtacaacttcgcaacagtcgtatcgacaaccccgactacgaccgtattatcagtcccgtccttaacaacgatggagaattttttgattcagacgagtataactcctacatcgatgcccagaaagcgcccttaccgatcgacgccgacgcaaacggagcattttgcatcgcacttaaggggatgtacactgccaaccagattaaggaaaattgggtagaaggtgaaaagttacccgctgattgtcttaaaattgagcatgcgtcctggttagctttcatgcagggcgagcgtggatag

SEQ ID NO: 94 - DNA, 3828 bp, Artificial Sequence
  Description of Artificial Sequence: Synthetic polynucleotide
atgggtaaaaaccagaattttcaggaatttatcggtgtttccccacttcaaaagacattgcgcaacgaacttatccctactgagacgactaaaaagaacatcactcaattggaccttctgacagaagacgaaattcgtgcgcaaaatcgtgagaaacttaaggagatgatggacgattactatcgtgacgttatcgattccacactgcacgcgggtatcgctgtcgactggtcttacctgtttagctgcatgcgcaaccacttgcgtgagaatagcaaagagagcaaacgcgaattggagcgtacgcaggactcaattcgttcccagatttataataagtttgcagagcgtgctgatttcaaggatatgtttggtgcgagcatcatcactaaattgctgcccacgtatatcaaacagaatcctgagtattcggagcgctatgatgaaagcatggagatccttaaattatatgggaaatttacgacaagcttgaccgactattttgagacgcgcaaaaatatcttttccaaagagaagatttccagcgccgtaggttaccgtattgtcgaggagaatgcggaaatttttttgcaaaaccaaaatgcgtatgaccgtatctgtaaaatcgccggtctggatcttcatggcttggataacgaaatcacggcatacgtcgatggtaagacccttaaagaagtctgttctgacgagggtttcgccaaggcaattacccaagagggaattgaccgctacaacgaagctatcggcgccgttaaccaatatatgaatcttctgtgtcaaaaaaacaaggccttaaaacccggacagttcaaaatgaagcgtttacacaagcaaattctgtgtaagggaacgacgtcttttgatattccaaaaaagttcgaaaacgacaaacaagtttacgatgccgtcaactcctttactgagattgttatgaaaaacaatgatttgaagcgcctgttgaacatcacgcaaaatgtcaatgactacgacatgaacaagatttacgtggccgccgatgcgtatagtacaatcagtcagttcattagcaagaaatggaatttgatcgaagaatgtttgttagactactatagtgacaatttacccggaaagggcaacgcaaaggaaaacaaggttaaaaaagctgttaaggaggaaacctatcgtagtgtcagccaattgaacgagttaatcgaaaaatactatgtagaaaaaacgggacagtccgtttggaaagtcgaaagttacatttcccgcctggcagaaactattaccttggagctttgtcatgaaatcgaaaacgacgaaaagcacaatttgatcgaggacgacgataaaatttcaaagattaaagaattgttagacatgtatatggatgccttccacatcatcaaagttttccgtgtcaacgaggttttaaattttgacgagacattctactcagaaatggatgagatctatcaggatatgcaagaaatcgtgccactttacaatcatgtgcgcaattacgtcactcagaaaccgtataagcaggagaagtatcgcctttacttcaacactccgacactggcgaatgggtggtcgaagaacaaggaatacgacaataacgccattatcttaatgcgcgacgataaatattatctgggcatcctgaacgcaaagaaaaaaccatctaagcaaacgatggcggggaaagaagactgcttggagcacgcctacgcaaaaatgaattactacttgttgccaggcgcgaacaaaatgcttcccaaagtatttttgtccaaaaagggcattcaggactatcacccttcatcatacattgtggagggttataatgagaaaaaacacatcaaaggatctaagaactttgatatccgcttctgccgtgacttgatcgactattttaaggaatgtatcaagaagcatcctgactggaacaagttcaattttgagtttagtgccacagaaacttacgaggatatctcagtcttctaccgtgaagtcgagaaacagggctatcgcgtagagtggacatatatcaacagcgaagatatccagaaactggaagaagatggtcagttattcttgttccagatctataataaggattttgcggtaggaagtactggcaaaccaaatcttcacacactgtatctgaaaaatcttttttcggaagagaatctgcgcgatattgtgctgaaacttaatggggaggcggaaatctttttccgcaagtcatccgttcaaaagcctgttattcataaatgtggttccattctggtaaatcgcacgtatgaaatcaccgagtcgggcacgacccgcgtccagtcgattcctgagtccgagtatatggagttgtaccgttattttaacagcgagaaacagatcgaattatccgacgaggcaaaaaaataccttgataaagtacaatgtaacaaggcgaaaacggatattgttaaagattatcgctacaccatggacaaattcttcattcacttacctattaccattaactttaaggtcgacaagggcaacaatgttaacgctatcgcacaacaatacattgcagagcaagaagacctgcatgttattgggatcgaccgcggggagcgcaatttaatttacgtctcggtgattgatatgtatggccgtattttagagcaaaaaagtttcaacctggttgagcaagtgtcttcgcaaggtaccaaacgttactacgattataaggagaaattacagaatcgcgaggaggagcgcgataaggctcgcaaatcgtggaagacaatcggtaagatcaaggagcttaaagagggctatttaagctcagtgattcatgaaattgcgcagatggtcgtcaagtataatgccattattgcaatggaggaccttaactatgggttcaagcgcggacgtttcaaagtcgaacgccaagtatatcagaagttcgaaactatgcttatctctaagttaaactacttagctgataaatctcaagctgttgatgaaccggggggtatcctgcgtgggtaccaaatgacatacgtcccggataacatcaaaaatgtaggccgtcagtgtggtatcattttctacgtgccggctgcatatacgagtaaaatcgaccccacaacaggatttatcaatgcctttaaacgtgacgtcgtttcaaccaacgatgcaaaggagaatttcctgatgaaatttgattcgatccaatacgacatcgagaaaggtctgtttaagttttcgttcgactataaaaactttgcgacgcacaaacttacgttagccaaaacaaagtgggacgtatatactaacggaacacgtatccagaatatgaaagtcgaaggtcactggcttagtatggaggtagagcttactaccaagatgaaggagttattagatgactctcatattccttatgaagaagggcaaaatatccttgatgatcttcgcgagatgaaagatattacaaccatcgtaaatggtatccttgagattttttggttgacggtgcagcttcgcaactcgcgtattgataaccccgactacgatcgcattattagcccggtacttaacaatgacggggagttctttgatagcgatgagtataattcctatatcgacgcacagaaagcaccattacccatcgacgccgacgccaacggggctttctgtatcgctttaaaaggtatgtacaccgccaatcaaatcaaggaaaactgggtcgaaggggagaaattgccggcagattgcttaaaaatcgagcacgcgagttggctggcctttatgcagggagaacgcggctag

SEQ ID NO: 95 - DNA, 3786 bp, Moraxella sp.
atgaatacaagtttattttcatcattcactcgccaatatccagttaccaaaaccttgcgttttgaattaaaaccaatgggtgcgacattggggcacattcagcaaaaaggttttttacacaaagatgaagagctggcaaaaatttacaaaaaaatcaaagaactgcttgatgagtatcatcgggcgtttattgcagatacgctgggcgatgctcagcttgtgggcttggatgatttttatgcagattatcaagcactcaaacaagacagtaaaaacagtcatctaaaagataagctcaccaaaacccaagacaatttacgcaaacaaatcaccaaaaattttgaaaaaacaccacagcttaaagaacgctataagcgtttgtttactaaggagctgtttaaagctggtaaggataaaggagatttggaaaaatggctgataaatcatgacagtgagccaaataaggcagaaaaaatctcatggattcatcaatttgaaaattttaccacctattttcaaggattttatgaaaatcgcaaaaatatgtacagtgatgaagtcaaacatactgccattgcttatcgtttaatccatgaaaatttgccacgctttgttgataatatacaagttttatccaaaatcaaatcggattatcctgatttatatcacgaattgaatcatttggacagtcgcacgattgattttgctgattttaagtttgatgatatgttacagatggatttttatcatcatctgcttatccaatcaggcatcaccgcttataatacgcttttgggcggtaaagtattagaaggtggtaaaaagttgcaaggcatcaatgagttaataaatctatatggtcaaaaacataaaattaagattgcaaaattaaagcctttgcacaaacaaatattaagtgatggacaaagcgtctcatttttgcccaaaaagtttgataatgattatgaattgtgccaaactgtcaatcatttttatcgtgaatatgtggctatttttgatgagctggtggttttatttcaaaaattttatgattatgacaaagacaacatatatatcaaccatcaacagctcaatcaactatcgcatgagttatttgctgattttaggttattatcacgtgcgttggacttttattattgtcagataattgatggtgattttaataataaaatcaacaacgccaaaagccaaaatgccaaagaaaaattattaaaagaaaaagagcgatacaccaaatcaaatcatagcatcaatgaattgcaaaaggcaatcaaccactatgccagtcatcatgaagacacagaagttaaagtcattagtgattatttttcagcgacaaacattcgtaatatgattgatggcattcatcatcattttagtacaatcaaaggttttttggaaaaggataataaccaaggcgagagttatctgcccaaacaaaaaaacagcaatgacgttaaaaatttaaaattatttttagatggtgttttgcgactgattcattttatcaaacctttggcattaaaatcagatgataccctagaaaaagaagagcatttttatggggagtttatgcctttgtatgataaattggtaatgtttacgctgctgtataataaagtgcgtgattatattagtcaaaaaccctataatgatgaaaaaatcaaactcaactttggcaattcaactttattaaatggttgggatgtcaataaagaaaaagataattttggggtgatattatgcaaagagggtttgtattatttggcgattttagataaatcccacaaaaaagtctttgataatgcaccaaaagcaaccagtagccacacatatcaaaagatggtatataagctactgccaggacctaataaaatgctgcccaaagtgttttttgcaaaaagtaatattggttattatcagccatcggcacaattattagaaaactatgaaaaaggcacacacaaaaaaggcagtaattttagtttaacagactgtcatcatttgattgatttttttaaatccagcattgccaagcatccagagtggaaagagtttggttttagattttctgacactcacacttatcaggatttaagtgatttttataaagagatagagccgcaatcttataaagttaagtttattgatattgatgctgattatattgatgatttggttgaaaaaggtcaattatatctgtttcaattatacaataaagatttttcaaagcaatcttatggtaaaccaaatctgcacaccttatattttaagtcattgtttagtgatgataatctcaaaaatccgatttataaactcaatggcgaagctgagatattttatcgccgtgcttcattgagtgtgtctgatacgaccattcatcaagcaggagaaatattaacacccaaaaatcccaataatacccataatcgcacattaagttatgatgtgattaaaaataaacgctatacaacagataagttttttctgcacataccgattaccatgaactttggtatagaaaatacaggatttaaagcatttaatcatcaagtcaataccactttaaaaaacgctgataaaaaagatgtgcatatcatcggtattgaccgtggagaaagacatttgttgtatgtcagcgtgattgatggcgatggtcgtattgtggagcagcgaacgttaaatgatattgtatccatttctaataatggcatgagcatgagtacgccgtatcatcagatattggataacagagaaaaagagcgtttggcggctcgcaccgattggggggatattaaaaatatcaaagaattaaaggcagggtatttaagtcatgtggtgcatgaagtggtgcagatgatgttaaaatataatgccatgattgttttggaagatttaaattttggttttaaacatggtcgctttaaggtggaaaagcaagtttatcaaaattttgaaaatgcattgattaaaaaattaaattatttggtattaaaaaacgctgataatcaccagctaggttctgtgcgtaaggctttgcaattaaccaataattttaccgacataaaaagtattggcaaacaaacagggtttattttttatgtgccagcatggaataccagtaaaatagacccaaccacaggttttgtggatttgttaaaaccccgttatgaaaatatggcacaggctcaaagttttatcagcaggtttaaaaagattgcttataatcatcagcttgattattttgaatttgagtttgattatgccgatttttatcaaaaaacgatagataaaaaacgtatttggactttatgcacttatggtgatgtgcgttattattatgaccataaaactaaagaaacaaagaccgttaatattaccaaagagttaaaatcattgttggataagcatgatttaagttatcaaaatggtcataatttggtagatgagctggcaaattctcacgacaagtcattattaagtggcgtgatgtatttattaaaagttttgttggcattaagatatagtcatgctcaaaaaaatgaagattttattttatcccctgtgatgaataaagatggtgtgttttttgacagtagatttgctgatgatgtgttgccaaataatgctgatgcaaatggtgcttatcatattgctttaaagggattatgggtgctcaatcaaatccaatctgccgataatatggataagattgatttgagcatctctaatgagcagtggctacactttacacaaagccgctaa

SEQ ID NO: 96 - DNA, 3786 bp, Artificial Sequence
  Description of Artificial Sequence: Synthetic polynucleotide
atgaacacgtcacttttcagcagttttactcgtcagtatcctgttactaaaacgttgcgctttgagctgaaacccatgggagccactcttggccacattcaacagaaaggatttctgcacaaggacgaagagctggctaagatttacaagaaaattaaggaattgctggatgaatatcaccgtgcattcattgccgacaccttaggggatgcgcagttagtaggattggacgacttttatgccgattaccaggcacttaaacaagattcgaagaattctcaccttaaagacaagctgacgaagactcaggataacctgcgtaaacaaatcacgaaaaattttgaaaagacaccacaattgaaggaacgctacaaacgtttgttcaccaaggagcttttcaaagcaggaaaagataagggtgaccttgagaaatggttgatcaaccatgattcggaaccgaataaggccgagaaaatttcctggattcatcagtttgagaatttcactacgtactttcaaggtttctacgaaaatcgtaagaatatgtattccgatgaggtcaagcacacggctatcgcctaccgtttgatccacgaaaacttgccgcgtttcgttgacaacatccaggtccttagcaagattaaatcagactatcccgatctttaccatgaattgaaccatctggattctcgcactattgactttgcagattttaagttcgacgacatgcttcagatggatttttaccaccacttgcttatccagtctgggattacggcgtacaacactttattgggcggaaaggtattagaaggaggaaaaaagctgcaaggtattaatgaacttattaatctgtatgggcagaagcataagatcaagattgctaagctgaagccgctgcataaacagattttgagcgatggacagtccgtaagttttcttccgaagaagttcgataacgattatgaattgtgtcagactgtgaaccacttctatcgcgagtatgtagctatctttgacgaattagtggtcttgtttcaaaaattttatgactatgataaggacaacatttacatcaaccatcagcagttaaaccaattaagtcatgaacttttcgcagattttcgtctgttgtcccgcgcattagacttttattactgtcaaatcattgacggcgatttcaataacaaaatcaataacgctaagtctcagaacgcgaaggaaaagctgcttaaagagaaagagcgttataccaaatcaaatcactccattaatgagttgcaaaaggctatcaatcattacgcatctcaccacgaggacactgaggtaaaggttatttcagactatttctccgctacgaacattcgtaacatgatcgacggtattcaccaccatttttcgactatcaagggcttcttggaaaaggataataaccaaggcgaaagctaccttcccaagcagaaaaatagtaatgatgtgaaaaatttgaagctgtttcttgacggggtattacgcttaattcactttattaaacccttggccttaaaatcagacgacactctggaaaaagaagaacatttttatggggaatttatgcccctgtatgacaaattagtcatgtttacgcttttatacaataaggtacgtgattatattagtcaaaagccatacaatgatgaaaaaattaagctgaactttgggaatagcactctgctgaacggctgggacgtcaataaggaaaaagataatttcggggtaattttatgcaaggagggtctgtattatctggccatcttagataaatcccacaaaaaggtgtttgataacgctccgaaggcgacctcctctcatacctatcagaaaatggtttacaagcttctgcccggaccgaacaagatgttaccgaaggtcttcttcgctaaatccaacattggttactatcaaccttctgctcagctgcttgaaaactacgaaaaaggcacccataagaagggttcgaacttcagcttaaccgactgccaccacttaatcgactttttcaaatcgagtatcgccaaacacccagaatggaaggaatttggattccgcttttcggacacccacacataccaagacctttccgacttttacaaggagattgaaccccaatcttacaaagttaagttcattgatatcgacgcagactacatcgatgatcttgtggaaaagggtcaattatacctgtttcagttgtacaataaagacttctccaaacaatcttacggaaagccaaacttacacacgttatactttaagtcacttttctccgatgataatctgaagaacccaatctacaaattgaatggagaggctgaaattttctatcgtcgtgcttccttaagtgtgtctgatacaactatccatcaggcgggagagattttaacacctaaaaaccccaacaatacacacaatcgcaccttatcctacgatgttattaaaaataagcgttatacgactgacaagtttttcttgcacattcccatcactatgaatttcggcatcgagaatactggctttaaggccttcaatcaccaagttaacacaacactgaaaaatgccgacaaaaaagatgtgcacatcattggaattgaccgtggagaacgccacctgctgtatgtttctgtcattgacggggacggacgcattgtggaacaacgtaccctgaatgacattgtttcaatttctaataacgggatgagcatgagtaccccctatcaccagatcttagacaaccgcgaaaaagaacgcttagcagcacgtactgattggggcgacatcaagaacattaaggagcttaaagctggttacctttcacatgtggtacatgaggtggttcaaatgatgcttaagtataatgcgatgattgtgctggaggatttaaattttggatttaaacatggtcgcttcaaggtggaaaaacaagtgtatcagaatttcgagaatgcactgattaagaaacttaattatttagtccttaaaaacgccgacaatcatcaactgggaagtgtccgcaaagccttacaactgaccaataattttacggacattaagagcatcggcaagcagaccggttttattttctatgttcctgcctggaatacatccaagattgatccgaccactggcttcgtggacctgcttaagcctcgctacgagaacatggcacaggcacagtcttttatctcgcgcttcaagaagatcgcctataatcatcaactggactattttgaatttgagtttgactacgctgatttctaccagaagacgatcgataagaaacgtatttggacactgtgcacatatggtgatgtacgttattattacgatcataagactaaggagactaagacggtgaacatcacgaaagaacttaaatcgctgctggataaacacgatttgtcttaccagaacgggcataacttagtcgatgaattggctaactcccatgacaagtctctgttgagtggcgttatgtacttgcttaaagttttattagcacttcgttacagtcatgcccaaaagaacgaggacttcattttatccccggtaatgaacaaggatggcgtgttcttcgactcacgttttgcggatgacgtcctgccgaacaacgctgatgccaacggtgcgtatcatatcgccttaaaggggttgtgggtgttgaaccaaatccaatccgctgataatatggataaaatcgatctgtcgatttccaacgagcaatggctgcattttacgcagtcgcgctaa

SEQ ID NO: 97 - DNA, 3786 bp, Artificial Sequence
  Description of Artificial Sequence: Synthetic polynucleotide
atgaatactagcctgttcagctcattcactcgccaataccccgttacgaaaactttacgttttgaattgaagccaatgggagctactttaggacatatccagcagaagggattcttacataaggatgaagaattggcaaaaatttataaaaaaatcaaggagctgttggatgagtaccatcgcgccttcattgcggataccttgggggacgcacaactggttgggcttgacgatttttacgccgactaccaagcgcttaaacaagatagtaaaaattcccatcttaaggacaagctgaccaaaactcaggacaacttacgtaagcaaattactaagaatttcgagaaaactcctcagctgaaagagcgttataaacgtcttttcacgaaagaattatttaaggcagggaaagataaaggggatttggagaagtggttaatcaaccatgatagcgaacctaacaaggctgaaaagatttcgtggatccatcaattcgaaaatttcaccacatatttccagggtttctacgagaatcgcaagaatatgtactccgatgaagtgaagcatactgctattgcttaccgcttgattcacgagaatttgccgcgctttgttgataacatccaggtgctgtcgaagattaaatccgattatccagacctgtaccacgaactgaatcacttagatagccgcacaatcgactttgctgattttaaattcgatgatatgcttcaaatggacttttaccaccacctgttaattcagagtggtatcaccgcttacaatacattacttggcggtaaagtgttggaagggggaaagaagctgcaggggatcaatgagttaatcaatttatatggtcaaaaacacaaaatcaaaatcgctaaactgaaacccttacataagcagatcctgagtgatggtcaatcggtgtcatttttaccgaaaaaatttgacaatgactacgagctgtgccaaacagtgaaccatttctatcgcgaatacgtggctatctttgacgagcttgtggtattgttccagaagttttacgattacgataaggacaatatctatatcaaccaccagcagttaaaccaattatcccacgaattatttgctgattttcgtttactgagtcgcgccctggacttttactattgccagattattgatggagattttaacaacaaaatcaacaatgcaaaaagccagaacgcgaaagagaagcttctgaaggagaaagagcgctacacaaagtcaaatcatagtattaatgagctgcagaaggcgattaatcactacgctagccatcatgaagatacagaagtcaaggtaatcagcgactacttctctgccacaaacattcgtaatatgatcgatggcatccatcaccatttctccacaatcaagggttttttggaaaaagataataatcaaggggagagctacctgccgaagcaaaagaattcgaacgacgtaaaaaacttaaaactttttttagacggtgttctgcgcttgatccacttcatcaagccgcttgcacttaaatctgatgatacgctggaaaaagaagaacacttttatggcgaatttatgccattatatgataagcttgtcatgtttacacttttgtataacaaggtgcgcgattacatttcacaaaaaccttataacgacgagaaaattaagttgaattttggtaatagtactttacttaacgggtgggatgttaataaagaaaaagataacttcggtgtaattctttgcaaggaaggactgtattatttggccattttggacaagtcccataagaaggtcttcgacaacgcgcccaaggcgacctcgagccatacttatcagaaaatggtctacaaacttttgccgggacccaataaaatgctgccaaaagtattttttgcaaagagtaacattggatattatcagcccagcgcccaacttttagagaattatgagaaagggacccacaaaaagggctctaatttctcattgacggactgccaccatttgattgatttttttaaaagtagcattgccaaacatcctgaatggaaagaatttggtttccgcttttctgacacacacacttaccaggacttatcagatttttataaggaaattgaacctcagtcttacaaagtgaaatttattgacatcgatgctgactacattgatgacttagttgaaaagggccaattgtatttgttccagttatataacaaggacttttcgaaacaatcatacggtaagccgaatttgcacactttgtattttaagtccttgtttagcgatgataatctgaaaaatccaatctacaaattgaacggggaggcagagattttttaccgtcgcgctagcctgtccgttagcgatacaactattcaccaagcaggagaaatccttacgcctaagaatccgaataacacgcacaatcgtactttaagttatgatgtaatcaaaaataaacgttataccacagataaatttttcctgcatatcccgatcacaatgaatttcggaatcgaaaatactggcttcaaagccttcaaccaccaagtgaataccacattaaagaatgctgacaaaaaagacgttcacattatcggaatcgaccgcggcgagcgtcatttactgtatgtcagtgtgattgacggggatggccgtattgtagagcagcgcactcttaacgatattgtgtcgatttccaataacgggatgtctatgtcgactccttatcaccagattttggataatcgtgaaaaggagcgccttgcggcccgtactgattggggtgatatcaagaacatcaaagaattgaaggcagggtacttatcacatgtagtgcatgaagtggtccagatgatgcttaaatacaatgcaatgattgtattggaagatttaaatttcgggtttaagcacggccgtttcaaggtggaaaagcaggtctatcaaaacttcgaaaatgccttgattaagaagctgaactatcttgtactgaaaaacgcggataatcaccaattgggctcagtccgtaaagccctgcagcttaccaacaactttaccgatattaaatctatcggcaagcagaccgggtttatcttttacgtgcctgcatggaatacctccaaaatcgaccccaccacgggctttgttgacttattgaaaccacgttatgagaacatggcgcaagcgcaatcttttatttcacgtttcaaaaaaatcgcctataatcatcaacttgattactttgagttcgaattcgattacgctgatttttaccaaaaaacaattgataagaaacgcatctggaccttgtgtacttacggtgatgtacgctactactacgaccacaaaacgaaggaaaccaaaactgtcaacattactaaagaactgaagagtttattggacaagcatgatctttcataccaaaatggccacaatcttgtagacgaacttgctaacagccatgataaaagtttattaagcggggtgatgtaccttctgaaagtgcttttagctttacgctattcacacgcccaaaagaatgaggatttcattctttcacctgttatgaataaggacggtgttttcttcgactcgcgttttgcagacgacgtactgccaaataatgctgacgctaatggagcttaccacattgctctgaaagggctttgggttcttaaccaaattcaaagtgcagataatatggataagattgatctttcaatcagtaatgagcaatggctgcacttcacccaaagccgctaa

SEQ ID NO: 98 - DNA, 3786 bp, Artificial Sequence
  Description of Artificial Sequence: Synthetic polynucleotide
atgaacacgtcactgttttcttctttcacgcgccaataccctgtcacaaagacgcttcgcttcgaattaaagcctatgggggcaaccttaggacacattcaacaaaaagggtttctgcataaagacgaagaattggctaagatctataaaaaaattaaagagttactggacgaatatcatcgcgcgttcattgctgatactttgggggatgcgcaattagtcgggttagacgatttttacgcagattatcaagcgctgaagcaggactcaaagaactcccacttaaaagataaattaactaaaacccaagataacttgcgcaagcaaattacgaaaaacttcgagaagacaccacaattgaaagaacgctataagcgtttgttcaccaaggaattgttcaaggccggaaaggataagggtgatcttgagaagtggttaatcaaccacgactcggaaccgaataaagctgaaaagatttcatggattcaccaattcgagaacttcacgacctatttccaaggattctacgagaatcgcaaaaatatgtacagtgacgaggtcaaacatacggccattgcatatcgccttattcacgagaaccttccgcgcttcgtcgacaacatccaggtcttatcaaaaattaagtccgattaccctgatctgtatcatgagttgaaccacttggatagtcgcacaatcgacttcgcagatttcaaattcgatgacatgcttcaaatggacttctaccatcatttgttaatccagagtgggattaccgcctacaatacgttattgggtggaaaagtccttgagggaggaaagaagttacagggaatcaatgaattaatcaatctgtacggacagaagcacaagattaagatcgcgaagttgaagccgttgcataaacaaatcttgtccgacgggcagtccgtctcgtttttaccgaaaaaattcgataacgactatgagttgtgccaaactgtgaatcacttctatcgcgaatatgtagcaatctttgatgagcttgtggtattattccagaaattttacgactacgacaaagacaatatctatatcaaccatcaacagttaaaccagctttctcatgaactttttgccgattttcgtttactttcgcgcgccttagacttctattactgtcagattattgatggtgacttcaataataagatcaataacgctaaatcgcagaatgccaaagagaagctgttaaaggagaaagagcgttatacgaaatcaaatcactcgatcaacgagttacaaaaagccattaatcattatgcaagccaccacgaagacacggaagttaaagtaatttcagattatttctccgccactaacatccgcaacatgatcgatgggatccatcatcatttctctactatcaaggggtttctggaaaaagataacaatcaaggggaatcctatctgcctaagcagaagaatagtaatgatgtaaaaaatttaaagctttttctggacggagtcttgcgtttgattcactttattaagccgctggctcttaaatctgatgatacccttgagaaagaagagcacttttatggcgagttcatgccattatatgacaaattagtgatgttcacgcttttgtacaataaagtgcgcgactacatttcccagaaaccatacaacgatgaaaaaattaaactgaattttggtaattcaacgcttttaaacggctgggatgtgaataaggaaaaggataattttggtgtgatcttgtgtaaggaggggttatactacttagcgatccttgataaaagtcacaagaaagtgtttgacaacgcgccaaaagctacatcttctcatacctaccagaagatggtctacaagctgcttcctggaccgaacaaaatgctgcccaaggtcttttttgcgaaatccaacatcggctactaccagccgtctgcgcaacttttggagaactacgagaaagggacccacaaaaaagggtcgaatttctcgcttaccgattgtcaccatttgatcgacttcttcaaaagttcaatcgcgaaacaccccgaatggaaagagttcggcttccgcttctccgacacacatacctatcaggaccttagcgatttttataaggaaattgaaccccaaagctataaagtcaagttcattgacatcgatgcggactacatcgacgaccttgtagaaaagggtcagctttatctgtttcagctgtataacaaagacttttcgaaacagtcctatgggaagccaaacttgcatactttatatttcaaatcgctgttttccgatgataatttgaagaaccctatttataaattgaacggagaagccgaaatcttctaccgtcgtgcgagcttgagtgtctctgacacaacaattcatcaagcaggtgagattttgacgcccaagaatcctaataatacgcacaaccgtacgttaagttatgacgtgatcaaaaacaagcgttacacgacggataaattctttctgcatatcccgatcacgatgaactttgggattgagaacactgggtttaaggcattcaatcatcaggttaataccacattaaaaaacgcggacaagaaagatgtacatattattggtattgatcgcggggaacgccatttgctgtacgtttctgtaattgacggggacggacgcatcgtggaacaacgcacccttaacgatattgtatctatctcgaacaatggtatgtctatgtcgacaccgtatcaccaaattctggataatcgcgaaaaggaacgcttagcggctcgcactgattggggggacattaaaaatatcaaggagttaaaggctggctacctgtcccacgtggtgcacgaggtagtacaaatgatgttaaagtacaatgccatgattgttttagaggacttgaactttgggtttaagcatggtcgctttaaggttgaaaaacaagtataccagaacttcgagaatgctttaatcaagaaacttaactaccttgttctgaaaaacgcagataatcatcaacttggctcggtacgtaaagccttgcaattgaccaataacttcacagacatcaagtcgatcgggaaacagacgggatttattttttacgttcccgcgtggaacaccagtaagattgacccgacgactggttttgtagacctgctgaaaccacgctatgagaatatggcacaagctcagagttttatttctcgcttcaagaagattgcttataaccatcagctggattatttcgagttcgagtttgattacgcggatttctatcaaaaaactatcgacaaaaagcgcatctggaccttgtgtacgtatggtgatgttcgttattactatgaccacaaaaccaaagagacaaagactgtgaacatcacaaaagaattaaaatcgttacttgataagcacgatttgtcatatcaaaacgggcataaccttgtggatgagttggcaaattcacatgataaatccttattatcaggggtgatgtatttacttaaggttttactggctttacgttatagccacgcacaaaagaatgaggacttcatcttgagtcccgtaatgaacaaggacggtgtatttttcgactctcgcttcgccgacgacgttcttccgaataatgctgacgccaacggagcataccatatcgcgttaaaggggttgtgggtattgaatcagatccagtcggctgacaatatggataaaattgatctttcaatctccaatgaacaatggctgcactttacccagtcacgctaa

SEQ ID NO: 99 - DNA, 3867 bp, Coprococcus sp.
atggtaggtaataaaatatcaaattcgtttgattcgtttactggaatcaacgcattaagtaaaacgttaagaaatgagttaattccatcagattatactaagagacatattgctgagagtgattttattgcggctgatacaaacaaaaatgaagatcagtatgtagcaaaagaaatgatggatgattattatcgcgattttataagtaaggttctagataatttacatgatatagaatggaaaaatttgtttgaattaatgcataaagcgaaaatagataaaagtgatgcaacttcaaaagagttgataaaaattcaggatatgcttcgtaaaaaaataggaaaaaaattctctcaagatcctgaatataaagtcatgctcagtgctggtatgataacaaagattttaccaaaatatatattggagaaatatgaaactgatagagaagacagattagaagcaataaaaagattttacggattcacagtttattttaaagaattttgggcaagtagacaaaatgtattttctgataaggcaatagcgtcatctatatcatatagaatcatacacgagaatgccaaaatatatatggataacctggatgcttataatagaataaaacagattgcttgtgaagaaattgagaagattgaagaagaggcatatgattttctgcaaggtgaccagttagatgtggtatataccgaagaagcatatggacgatttatatcccagagtggaatagatttatataataatatatgtggggttattaatgctcatatgaatttatattgccagagcaaaaaatgctccagatcaaagtttaaaatgcaaaaattacataaacagattttatgtaaagcagaaaccgggtttgaaattccattaggctttcaagatgatgcgcaagtgataaatgcgattaattcatttaatgctctaataaaagaaaaaaatattatatcacgtctcagaactatagggaaaagcatatctttatatgacgtaaataagatatatatttcatctaaagcgttcgagaatgtctctgtatacattgatcataaatgggatgtgatagcttcaagcttgtataagtatttctcggaaattgtcaaaggaaataaagacaacagggaagaaaagattcagaaggaaattaagaaagtaaagagctgtagtctgggtgatttgcagagactggttaattcatattataaaatagatagcacatgtttggagcatgaagtaactgaatttgttactaaaataatagatgagatagataactttcaaattacggattttaaatttaacgacaaaattagcttgattcaaaatgaacagattgtcatggatataaaaacatatcttgataaatatatgagtatttatcattggatgaaatcgtttgtgattgatgagctagttgataaggatatggagttttattcagaacttgatgaacttaatgaggatatgtcggaaattgtgaatttatataacaaagtgcgtaactatgttacacagaagccttatagtcaggaaaagataaaattgaacttcggatcaccgactcttgccgatggatggtcgaaatcaaaggaatttgataacaatgctattatattgattcgtgatgaaaaaatatatttggcaatatttaacccaagaaataaaccagctaagactgttatatcaggacacgatgtttgcaattctgaaacagattataagaaaatgaattattatttgctccctggggcaagtaagactttaccacatgtgtttattaagtctagattgtggaatgaatcacatggaatacctgatgaaatattgcggggatatgagttgggtaaacacttgaaatcatcggtaaattttgatgtagaattctgctggaagctaattgattattataaagaatgtataagctgttatccaaattataaggcgtataattttaaatttgctgatacagaatcgtacaatgatatatcagaattctatagagaagtggagtgtcagggatataagattgactggacatatataagttcagaagatgtagaacaacttgatcgtgatggtcaaatatatctgtttcaaatctataataaagactttgcaccgaatagtaaaggaatggataatcttcatacgaagtacctcaaaaatatatttagcgaagacaatcttaaaaacatagttataaaattgaacggagaggcagaattattttatagaaaatcaagtgtcaagaaaaaagtagaacataaaaagggtacgattttagtcaataaaacatataaggttgaggataacactgaaaacagtaaagaaaaaagagttattattgaatcagtaccagatgattgctatatggaacttgttgattattggagaaatggtggtatcggaattctttcagacaaagctgttcaatataaggacaaagtatctcattatgaagctactatggatatagtcaaggatcgcaggtatacagtagataagttttttatacatttgcctataactatcaatttcaaagcagatggaagaattaatataaatgaaaaggtactcaagtatatagcggaaaatgatgagcttcatgtgattggaattgatagaggagaaagaaatctcctttatgtgtcagtaattaataaaaagggaaagattgttgagcagaagtctttcaatatgatagaaagctatgaaactgtaacaaatatagttagaagatataattataaagacaaactggtcaacaaagaaagtgcccggacagatgcgagaaaaaattggaaagaaattggaaagataaaagaaataaaagagggatacttgtcacaggtaattcatgaaatatcgaagatggtgttgaaatataatgcaatcattgttatggaagatctaaattatggatttaaacgaggtaggtttagggttgaacgtcaggtataccagaaatttgagaatatgttgatatctaaactggcatacttggtagataaaagtcgaaaagccgatgaaccaggaggtgtactaagagggtatcagcttacgtatattccagattctttagagaaacttggtagccagtgtggaatcatattctatgtacctgctgcgtatacatctaagattgatccgttaacaggctttgtaaatgtattcaattttagagaatattctaattttgaaacaaaattggattttgttagatcattagacagtatacgatatgatacagagaagaaattgttttcaatatcatttgattatgacaactttaaaacacataataccactctggcaaaaacgaagtgggttatatatttacgaggcgagcgtataaaaaaggaacatacatcttacgggtggaaggatgatgtttggaatgtggaaagtagaattaaagacttgtttgacagttcacatatgaaatacgatgatggacataatttaattgaagatattcttgaattagaatcgagtgtacagaagaagctgatcaatgaattgatagaaataataaggttgactgttcaacttcgtaacagtaagtcagagagatacgataggacagaagctgaatacgacagaatagtatcgccagttatggatgaaaatggacggttttatgattcggaaaattatattttcaatgaagaaacagagttaccaaaggatgcagatgctaatggtgcatattgcattgcattaaaaggtctgtacaatgtcatagccataaagaataactggaaagaaggagagaaattcaacagaaaattgttaagtctaaataattataactggttcgattttatacaaaatagaaggttttaa

SEQ ID NO: 100 - DNA, 3867 bp, Artificial Sequence
  Description of Artificial Sequence: Synthetic polynucleotide
atggtaggcaacaagatctcaaacagttttgacagctttacaggcatcaacgcgttgagcaagacccttcgcaatgaattaatcccatctgattacactaaacgccacattgcagaaagtgactttattgctgccgatactaataaaaatgaagatcaatacgttgctaaggagatgatggatgactattaccgcgattttatttctaaagtattggataacttacacgacattgagtggaaaaatttgtttgaattgatgcacaaggccaaaattgataagagcgatgctacttcaaaagagttgattaaaatccaagatatgttgcgtaagaagattggtaagaagttctcgcaggaccctgagtacaaagtgatgttatcggctggcatgattacaaagattcttcctaagtatatcctggagaaatacgaaacggaccgtgaggatcgcttggaagcaatcaaacgcttctacgggttcaccgtgtattttaaggagttctgggcgagtcgccaaaatgtcttctctgacaaggcaatcgcatcatctatcagctaccgcatcattcacgaaaatgccaaaatttacatggacaatttggatgcatacaatcgtatcaaacaaattgcctgcgaggaaattgagaagattgaagaagaggcatatgactttctgcaaggagaccaacttgacgtggtgtatactgaggaggcgtatggtcgttttattagtcaaagtggtattgatttgtataacaatatttgcggcgtaatcaatgctcatatgaacttgtactgccaaagcaagaaatgttcgcgcagtaaatttaagatgcaaaagttacataagcaaattttgtgcaaggcggaaaccggttttgaaattcccctgggatttcaggacgatgctcaggtcattaatgcgatcaattcgtttaatgcgttaatcaaggaaaaaaatatcatctcccgccttcgtacaattggtaaatcgattagcctgtacgatgttaataaaatttacatttcctcgaaagcatttgaaaatgtttccgtctatattgaccacaaatgggatgtgattgctagttctttgtacaaatacttttcggaaattgtgaaggggaacaaggacaaccgcgaagaaaaaattcagaaggagatcaagaaggtaaagagttgcagcctgggggatttgcagcgcttggttaattcctactacaagattgattccacttgccttgagcacgaggtcacggaattcgtcaccaaaatcatcgacgagatcgacaatttccagatcacagactttaagtttaatgacaaaatttcgctgattcagaatgaacagattgtgatggatattaagacgtatcttgataagtacatgtcaatctatcattggatgaaatccttcgttatcgatgagctggtagataaagatatggagttttattcagagttggacgaactgaacgaggacatgtcagaaatcgtcaatttgtataataaggttcgtaattatgttacgcaaaagccctactcgcaagagaagattaaattaaatttcggatcgcccaccttggctgacggatggtcgaaaagtaaagaattcgacaataatgctattattttgattcgcgatgaaaagatttatcttgcgatctttaaccctcgtaataagccggcgaagacagttattagtggccatgacgtgtgtaactctgagacggattacaagaagatgaactattatttattaccgggggcatctaagaccttaccgcatgtcttcatcaaatcgcgtctgtggaatgaaagtcacggtatcccagatgaaatccttcgtggctatgaattagggaaacacttaaagtcgtccgttaactttgatgtcgagttttgttggaagcttattgactactacaaggagtgtatctcgtgctatcctaactataaagcgtacaacttcaagttcgcagacaccgaatcctacaacgatatcagcgagttctatcgtgaagtagagtgccaaggatacaaaattgactggacgtacatttcttccgaggatgttgaacagttagatcgtgacgggcaaatttatttattccaaatttataacaaagacttcgctcccaattctaaaggtatggacaacctgcacaccaagtacttgaaaaatattttttcagaggataacttgaagaacattgttattaaactgaacggtgaagccgaattattctatcgcaaatcgagtgttaagaaaaaggtagagcacaagaaggggaccatcttggtaaacaagacatataaagttgaagataacactgagaactcgaaggagaagcgcgtgattattgagtctgtccctgatgattgctatatggaactggtggactactggcgtaacggcggcatcggtattttgagtgataaggctgttcagtataaggataaggttagccattatgaagcaactatggatatcgtcaaagaccgccgttatacagttgataaattctttattcatctgcctattactatcaacttcaaggcggatggtcgcatcaatattaacgaaaaggtgttaaagtatatcgccgaaaacgatgagttgcacgtaattgggattgaccgcggcgaacgcaacctgctgtatgtgtccgtgattaacaaaaaggggaaaatcgtagaacagaagagctttaatatgatcgaatcgtacgaaactgtcacaaatattgtgcgccgctataattacaaggacaaacttgtgaataaggaatccgcccgtacagacgcacgcaagaattggaaagaaattggaaagatcaaggaaattaaggagggatacttgagtcaggtgattcatgagatcagcaaaatggtccttaagtacaacgccatcatcgtaatggaagacttgaactacggatttaagcgcgggcgctttcgtgttgaacgccaggtatatcaaaaatttgagaatatgttgatctctaaacttgcttatcttgtcgataagagtcgcaaggctgacgaaccaggtggggtcctgcgcggataccaactgacctatatcccggactctctggaaaagttaggaagtcagtgcggcattatcttttacgttcctgcagcttatacgagtaaaattgatccactgactgggttcgtaaatgtctttaacttccgtgaatattcaaattttgaaacgaaactggattttgtccgctccttggattctatccgctacgacacagagaaaaagttgttttcaattagttttgattacgacaactttaaaactcataacactaccttagccaagacaaaatgggttatctaccttcgtggcgaacgcattaaaaaggaacatacctcctatgggtggaaggacgacgtttggaacgtggaaagccgtattaaagatctgtttgatagctctcacatgaagtacgacgacgggcataaccttattgaggatatcttggaactggagtcgtccgtacaaaagaagctgattaacgagctgattgaaattattcgccttacggttcaattacgcaactctaaatcggagcgttacgatcgtaccgaggcagagtatgatcgtatcgtgagtcctgttatggatgagaatggccgtttttatgattctgaaaactacatctttaatgaagagactgagcttcccaaggacgcagatgctaacggcgcctattgcatcgctttaaagggtttgtacaatgttattgctattaagaacaattggaaggaaggagaaaaattcaaccgcaaactgctttctttgaacaactacaattggtttgattttattcagaatcgtcgtttttaa

SEQ ID NO: 101 - DNA, 3867 bp, Artificial Sequence
  Description of Artificial Sequence: Synthetic polynucleotide
atggtgggtaacaagatcagcaattcctttgacagtttcactggaatcaacgccctttccaaaacactgcgtaacgaattgatcccgtcggactacaccaagcgtcatattgctgaatcggattttatcgctgcagacaccaataagaatgaagaccagtatgttgcaaaagagatgatggatgattattaccgcgatttcatttctaaagtcttagataatcttcatgatattgaatggaagaacctgttcgaattaatgcacaaagccaaaatcgacaaatccgacgcaaccagtaaagaactgatcaagatccaagatatgttacgcaagaagattggaaagaaattttctcaagacccagagtacaaagtgatgttgtccgctgggatgatcactaagatcttgcctaaatacatcctggaaaagtatgagaccgaccgcgaggaccgtcttgaagcaatcaagcgcttttatggtttcaccgtctacttcaaggaattttgggcgagtcgtcaaaacgtatttagcgataaggctattgcctcatctatttcttatcgcatcattcatgagaatgccaagatctatatggacaaccttgatgcatataaccgtatcaaacaaatcgcatgtgaggagattgagaagatcgaagaggaagcctacgatttcttgcaaggagaccaacttgatgtagtttacaccgaggaggcatatggacgctttattagtcagagcggtattgacctgtacaataatatctgtggtgttatcaatgcgcatatgaatttgtattgccagtctaaaaagtgttcgcgctcgaaatttaaaatgcaaaagttacataagcaaattttgtgcaaggccgagacgggtttcgagattccgttagggtttcaggacgacgcccaagtgattaacgccatcaattcgttcaacgctttgattaaagaaaaaaatatcatctcgcgcttgcgcacgattgggaagtctatctctttatacgacgtaaataagatctatatctcttctaaagcttttgaaaacgtgtccgtttacattgatcacaaatgggatgtaattgctagttccctttacaagtacttctccgaaatcgttaaaggtaacaaagacaaccgtgaagaaaaaatccaaaaagagattaagaaagttaagtcatgttccttaggcgacctgcaacgcttagtgaacagttattacaaaattgattctacatgtttagagcacgaggtcacagaattcgttacaaagattattgatgagattgacaactttcaaattacagactttaagtttaatgacaagatttctttaatccagaacgaacagatcgttatggacatcaagacttatcttgataaatatatgtcgatttatcattggatgaaaagttttgttattgacgagctggtggataaggatatggaattttattctgagcttgacgaactgaatgaggatatgtcggaaatcgtcaatttatacaataaagttcgcaattatgtaacccagaaaccctactcccaagagaaaatcaaacttaacttcggcagccccacgctggcggacgggtggagtaaatcaaaagagtttgacaacaatgcgatcatccttatccgtgacgaaaaaatttaccttgcgattttcaaccctcgcaataagcccgccaaaaccgtgatcagtggtcatgatgtctgtaattctgagactgattataaaaaaatgaattactatctgctgcctggtgcaagcaaaacgctgccgcacgtcttcattaagtcccgcttatggaacgagtcgcatggtattcctgatgaaatcttacgcgggtacgaactgggcaaacatcttaaaagcagcgttaatttcgatgtagagttctgttggaagctgatcgactactataaggaatgcatttcgtgttaccccaactacaaggcgtacaactttaagttcgcggacacagaaagttataacgatattagcgagttttaccgcgaagttgagtgccagggatataagattgactggacttatattagtagcgaagacgttgagcaactggaccgtgatgggcaaatctacttgtttcagatttacaacaaggacttcgctcccaactcgaaaggtatggacaacctgcacacgaaataccttaaaaatattttttccgaagataacttaaagaatattgtcattaaactgaatggcgaagctgagttattttaccgtaagtcatccgtcaaaaagaaggtcgaacataaaaagggaacaatccttgtaaataagacgtataaggttgaggacaataccgagaattcgaaggaaaagcgtgtgatcattgaatcggtgccggacgattgctacatggaattagtggactactggcgtaacggtggcatcggcatcctgtcagacaaggcggtgcagtataaggacaaagtctcgcactatgaagccaccatggacattgtaaaggaccgtcgctacacggtggataagttctttatccatttgcctatcacgattaattttaaagcagatggtcgtatcaacattaacgaaaaggtgttaaaatacattgctgagaatgacgagttacacgttatcggaatcgaccgtggtgagcgtaaccttttatatgtctcagtaatcaataaaaaagggaagattgttgagcagaaaagcttcaatatgatcgaatcttacgagaccgtgacaaacatcgtgcgtcgttacaactataaagataagttggtaaataaggagagtgcccgcaccgacgcacgcaaaaactggaaagaaatcggcaagatcaaggaaatcaaggaggggtatttgtcacaagtaatccacgaaatttctaaaatggtattaaagtacaacgcaattatcgtcatggaagatttgaactacggcttcaagcgcggccgtttccgcgtcgagcgtcaagtatatcagaaattcgagaatatgttaatttccaagttagcatacttagtagataaaagccgcaaggctgatgaaccaggtggggttctgcgcggctaccaattaacgtacattcccgattccttagaaaagttgggctctcagtgcggtattattttttacgtccccgcagcatatacatcgaagatcgatccgcttaccggatttgtcaatgtctttaattttcgcgaatactctaatttcgagacaaagcttgacttcgtgcgcagtttggacagcattcgctatgatacggagaagaaacttttttcaatctcttttgactatgataatttcaagacccacaacacaacactggccaaaaccaagtgggtaatctacctgcgtggggagcgtatcaagaaggagcacacgtcgtatggatggaaggacgacgtatggaatgtggagtcacgtattaaggacctgtttgacagttcccatatgaaatatgacgacggccataaccttatcgaagacattcttgagttagagagtagcgtccaaaagaagttaatcaatgaacttatcgagatcatccgccttactgtgcagttgcgcaattccaagtcggaacgctacgatcgtacagaggccgaatacgatcgcatcgtctcccccgtaatggatgaaaacgggcgcttttatgattccgaaaactatattttcaacgaggaaacggaacttccaaaagacgcggacgccaacggtgcatactgcatcgccctgaagggcctgtataatgttatcgccattaagaacaattggaaagaaggtgaaaagttcaaccgcaaattactgtccctgaacaattacaactggttcgactttatccaaaatcgtcgtttctaa

SEQ ID NO: 102 - DNA, 3867 bp, Artificial Sequence
  Description of Artificial Sequence: Synthetic polynucleotide
atggttggtaataaaatcagtaattcttttgattccttcacaggtattaacgctttgtctaagactctgcgcaacgagcttattccgagtgattatacaaaacgtcatattgcggaaagtgacttcattgctgcggatacaaacaaaaacgaagatcaatacgtggcaaaagaaatgatggacgattactatcgtgactttatctcgaaagtactggacaatttgcacgatattgagtggaaaaatctgttcgaactgatgcataaagcgaaaattgacaagtctgacgccacatcgaaagaactgatcaagattcaggacatgcttcgcaaaaagattggcaaaaaatttagtcaagacccggagtacaaagtgatgttgtccgcggggatgattaccaagattcttcccaaatacattttggaaaaatacgagaccgaccgcgaggaccgtcttgaagcaattaaacgtttctacggctttactgtttacttcaaggagttttgggcgagccgtcaaaatgtgttctcagacaaagctattgcctcgtcgattagttatcgcattattcatgaaaatgcaaagatctacatggacaacttagatgcctacaatcgcattaaacaaatcgcttgcgaagagattgaaaagattgaggaagaagcatatgacttccttcagggcgatcagcttgacgtcgtgtacactgaggaggcatatggacgcttcatcagccagtctgggattgatctgtacaataatatctgtggtgtcatcaatgctcatatgaacttgtactgccagtcgaagaaatgtagtcgctctaaattcaaaatgcaaaaactgcacaagcagattctgtgtaaggcagaaaccgggttcgaaatcccgctgggttttcaagatgacgctcaggttattaacgcgattaattcgttcaacgcacttattaaagaaaaaaatattatcagtcgcctgcgcactattggcaaatctatcagtttgtacgacgtaaataagatttacatcagctctaaagcgttcgaaaacgtgtccgtatatattgaccacaaatgggacgtgattgcgtcctcgttatacaaatatttttcggaaatcgtcaaagggaacaaggacaaccgtgaagagaagatccagaaggagattaagaaagttaaaagttgttccttgggggacttacagcgtttagtgaactcttattataaaattgattccacgtgcctggagcacgaagtaaccgaattcgtgacgaagatcattgatgaaattgataacttccagatcaccgactttaagtttaacgacaagatctctctgattcaaaacgagcagattgtgatggatatcaagacctatttagacaagtatatgtcgatctatcactggatgaaatcgttcgtcatcgacgaactggtcgacaaggatatggagttttactcagagttagatgaattgaacgaagacatgtctgagatcgtaaatctgtataacaaagtacgcaactacgttacccaaaaaccgtactcgcaggaaaagattaaactgaattttggaagtcccacactggcagacggatggtctaaaagtaaagaatttgataataacgcgatcattcttattcgcgatgaaaaaatttatttagcaatctttaatccacgtaataagccggccaagacggtgatctcgggccatgacgtttgcaattcggaaacagattacaaaaagatgaattattacttactgcctggtgcgtcgaagacgttaccgcacgtctttatcaagtctcgtctgtggaacgagtcccacggtatcccagacgagatcctgcgcggttatgagctggggaaacacctgaaatcatccgtaaattttgacgtcgagttttgctggaaacttattgactactataaagagtgcatctcttgttatccgaattataaagcatacaactttaagttcgctgatacagaatcctacaacgacatcagcgaattctaccgcgaagttgagtgccaggggtataagattgactggacatatattagctcagaagacgttgagcagttggaccgtgatgggcagatctatttgttccagatctataacaaagattttgcgccgaattcaaagggcatggataatcttcacacgaaatacctgaagaatattttctctgaagataatttgaagaacatcgtgatcaagcttaatggcgaagcagaattattctaccgcaaatccagcgttaaaaagaaggtggaacataaaaaaggtacgatccttgttaataagacttataaagttgaggataataccgagaactctaaagaaaagcgcgttattattgaatcagtcccagacgattgttatatggaacttgtggactactggcgtaacggcgggatcggcattctgtctgacaaggccgtacagtataaagacaaggtctcacactatgaggccacgatggacattgttaaagaccgccgttacacggtcgataagttctttatccatcttcccatcactatcaactttaaagctgatggccgtatcaatattaatgaaaaggttctgaagtatatcgccgagaacgacgagttgcatgtgattggaattgatcgcggtgagcgcaaccttctgtatgtttcggtgattaataaaaagggtaagatcgtcgagcagaaaagttttaacatgattgagtcttatgagacagtcactaacattgtccgtcgctataattataaagataaactggttaacaaagagtcagctcgcacggacgctcgtaagaattggaaggaaatcgggaagattaaagagattaaagaggggtatttatcgcaggtcattcacgaaatttccaagatggtgcttaagtataacgcgattattgtgatggaggatttgaactatgggttcaaacgcggacgctttcgcgtcgaacgccaggtctaccagaagttcgagaatatgcttatcagcaagctggcgtatcttgtggacaagtctcgcaaggcagacgagcccggcggcgtcttacgtggctaccaattgacgtacatcccggacagtttggagaaattgggatcccagtgcggtattatcttttacgtaccagcggcatacacatcaaagattgatccccttaccggcttcgtgaacgtgttcaactttcgtgaatatagcaacttcgagaccaaactggatttcgtgcgctccttagatagcattcgctacgataccgaaaagaaacttttcagcattagcttcgattatgataacttcaaaactcacaacactaccttagcaaaaaccaaatgggtaatctatttgcgtggcgaacgcatcaaaaaggaacatacctcctatggctggaaggacgacgtctggaacgttgagtcgcgcatcaaggacttattcgactcgagtcacatgaagtatgacgatggacataatcttattgaagatattttggagttagaatcgagcgtgcaaaaaaagcttattaacgaacttattgaaattatccgcctgacagtacagctgcgcaacagtaagtcagagcgttatgaccgcactgaagcagagtatgatcgcattgtatcgccagtaatggatgagaatggccgtttctatgactccgaaaactacatttttaacgaggaaaccgaattgcccaaagatgctgatgcaaatggagcatattgcatcgcattgaaagggctttacaacgtgatcgccatcaaaaacaattggaaagaaggcgagaaattcaaccgcaaattacttagtcttaacaactataattggtttgattttattcagaaccgtcgtttctaa

SEQ ID NO: 103 - DNA, 3867 bp, Coprococcus sp.
atggtaggtaataaaatatcaaattcgtttgattcgtttactggaatcaacgcattaagtaaaacgttaagaaatgagttaattccatcagattatactaagagacatattgctgagagtgattttattgcggctgatacaaacaaaaatgaagatcagtatgtagcaaaagaaatgatggatgattattatcgcgattttataagtaaggttctagataatttacatgatatagaatggaaaaatttgtttgaattaatgcataaagcgaaaatagataaaagtgatgcaacttcaaaagagttgataaaaattcaggatatgcttcgtaaaaaaataggaaaaaaattctctcaagatcctgaatataaagtcatgctcagtgctggtatgataacaaagattttaccaaaatatatattggagaaatatgaaactgatagagaagacagattagaagcaataaaaagattttacggattcacagtttattttaaagaattttgggcaagtagacaaaatgtattttctgataaggcaatagcgtcatctatatcatatagaatcatacacgagaatgccaaaatatatatggataacctggatgcttataatagaataaaacagattgcttgtgaagaaattgagaagattgaagaagaggcatatgtttttctgcaaggtgaccagttagatgtggtatataccgaagaagcatatggacgatttatatcccagagtggaatagatttatataataatatatgtggggttattaatgctcatatgaatttatattgccagagcaaaaaatgctccagatcaaagtttaaaatgcaaaaattacataaacagattttatgtaaagcagaaaccgggtttgaaattccattaggctttcaagatgatgcgcaagtgataaatgcgattaattcatttaatgctctaataaaagaaaaaaatattatatcacgtctcagaactatagggaaaagcatatctttatatgacgtaaataagatatatatttcatctaaagcgttcgagaatgtatctgtatacattgatcataaatgggatgtgatagcttcaagcttgtataagtatttctcggaaattgtcaaaggaaataaagacaacagggaagaaaagattcagaaggaaattaagaaagtaaagagctgtagtctgggtgatttgcagagactggttaattcatattataaaatagatagcacatgtttggagcatgaagtaactgaatttgttactaaaataatagatgggatagataactttcaaattacggattttaaatttaacgacaaaattagcttgattcaaaatgaacagattgtcatggatataaaaacatatcttgataaatatatgagtatttatcattggatgaaatcgtttgtgattgatgagctagttgataaggatatggagttttattcagaacttgatgaacttaatgaggatatgtcggaaattgtgaatttatataacaaagtgcgtaactatgttacacagaagccttatagtcaggaaaagataaaattgaacttcggatcaccgactcttgccgatggatggtcgaaatcaaaggaatttgataacaatgctattatattgattcgtgatgaaaaaatatatttggcaatatttaacccaagaaataaaccagctaagactgttatatcaggacacgatgtttgcaattctgaaacagattataagaaaatgaattattatttgctccctggggcaagtaagactttaccacatgtgtttattaagtctagattgtggaatgaatcacatggaatacctgatgaaatactgcggggatatgagttgggtaaacacttgaaatcatcggtaaattttgatgtagaattctgctggaagctaattgattattataaagaatgtataagctgttatccaaattataaggcgtataattttaaatttgctgatacagaatcgtacaatgatatatcagaattctatagagaagtggagtgtcagggatataagattgactggacatatataagttcagaagatgtagaacaacttgatcgtgatggtcaaatatatctgtttcaaatctataataaagactttgcaccgaatagtaaaggaatggataatcttcatacgaagtacctcaaaaatatatttagcgaagacaatcttaaaaacatagttataaaattgaacggagaggcagaattattttatagaaaatcaagtgtcaagaaaaaagtagaacataaaaagggtacgattttagtcaataaaacatataaggttgaggataacactgaaaacagtaaagaaaaaagagttattattgaatcagtaccagatgattgctatatggaacttgttgattattggagaaatggtggtatcggaattctttcagacaaagctgttcaatataaggacaaagtatctcattatgaagctactatggatatagtcaaggatcgcaggtatacagtagataagttttttatacatttgcctataactatcaatttcaaagcagatggaagaattaatataaatgaaaaggtactcaagtatatagcggaaaatgatgagcttcatgtgattggaattgatagaggagaaagaaatctcctttatgtgtcagtaattaataaaaagggaaagattgttgagcagaagtctttcaatatgatagaaagctatgaaactgtaacaaatatagttagaagatataattataaagacaaactggtcaacaaagaaagtgcccggacagatgcgagaaaaaattggaaagaaattggaaagataaaagaaataaaagagggatacttgtcacaggtaattcatgaaatatcgaagatggtgttgaaatataatgcaatcattgttatggaagatctaaattatggatttaaacgaggtaggtttagggttgaacgtcaggtataccagaaatttgagaatatgttgatatctaaactggcatacttggtagataaaagtcgaaaagccgatgaaccaggaggtgtactaagagggtatcagcttacgtatattccagattctttagagaaacttggtagccagtgtgggatcatattctatgtacctgctgcgtatacatctaagattgatccgttaacaggctttgtaaatgtattcaattttagagaatattctaattttgaaacaaaattggattttgttagatcattagacagtatacgatatgatacagagaagagattgttttcaatatcatttgattatgacaactttaaaacacataataccactctggcaaaaacgaagtgggttatatatttacgaggcgagcgtataaaaaaggaacatacatcttacgggtggaaggatgatgtttggaatgtggaaagtagaattaaagacttgtttgacagttcacatatgaaatacgatgatggacataatttaattgaagatattcttgaattagaatcgagtgtacagaagaagctgatcaatgaattgatagaaataataaggttgactgttcaacttcgtaacagtaagtcagagagatacgataggacagaagctgaatacgacagaatagtatcgccagttatggatgaaaaaggacggttttatgattcggaaaattatattttcaatgaagaaacagagttaccaaaggatgcagatgctaatggtgcatattgcattgcattaaaaggtctgtacaatgtcatagccataaagaataactggaaagaaggagagaaattcaacagaaaattgttaagtctaaataattataactggttcgattttatacaaaatagaaggttttaa

SEQ ID NO: 104 - DNA, 3867 bp, Artificial Sequence
  Description of Artificial Sequence: Synthetic polynucleotide
atggttggaaacaagatttcaaatagctttgacagcttcaccggaattaatgccttgtctaagacattacgtaacgaattgatcccgagtgactacaccaaacgccatattgcggagagtgacttcattgctgcggatacgaataagaatgaggaccaatatgtcgccaaggagatgatggacgattactaccgtgacttcatttccaaagtgttggacaacctgcatgacatcgagtggaagaatctgtttgagcttatgcacaaggctaaaattgataagagcgatgctactagcaaagagcttatcaagatccaggatatgctgcgcaagaaaattggcaaaaagttttcacaggacccagagtacaaagtaatgttatccgcgggcatgattacgaaaattcttcccaagtatattttggagaagtacgaaacagaccgcgaagatcgtttggaggcgattaagcgtttctacggcttcaccgtttattttaaagaattttgggcctctcgtcaaaatgtgttttcggataaggcgatcgcctcatctattagctaccgcatcatccacgaaaatgccaaaatctatatggataatcttgacgcctataatcgtatcaagcaaattgcatgtgaggagattgagaagatcgaggaagaggcatatgtgtttttgcagggtgaccaattggacgttgtgtataccgaggaagcctacggtcgctttatttcccagtcgggtattgacttgtacaacaatatttgcggagtgatcaatgctcatatgaacctttattgccaatcgaaaaagtgctcgcgcagcaagtttaagatgcagaaattgcataaacaaatcttgtgtaaagcggaaacagggtttgagattcccttaggattccaggacgatgcgcaagttatcaatgccattaattccttcaatgcactgattaaagaaaaaaatattattagccgtcttcgtactattgggaagtccattagtctttacgatgtgaacaagatttacatttcttcgaaggcgtttgagaatgtgtccgtgtatattgatcataaatgggacgtcatcgctagttctctgtacaaatacttcagtgaaatcgttaaaggcaataaggacaaccgtgaagagaagatccaaaaggagattaagaaagttaagtcgtgcagccttggggacctgcaacgtttggtgaacagctattacaaaattgattcaacgtgcctggaacatgaagtaaccgaattcgtaacaaaaattattgacggtatcgataatttccaaattacagacttcaagttcaacgataaaattagtcttattcaaaacgaacagatcgtgatggacatcaagacttacttggacaagtatatgtccatttaccactggatgaaatcgttcgttatcgatgagcttgttgataaagacatggaattctactccgaacttgatgaattaaacgaggacatgagtgagattgttaacttatacaataaggtccgtaattacgttacgcagaaaccgtatagccaggaaaagattaaattaaattttggcagcccgacattggctgacggatggagcaaatctaaggagtttgataataacgcgatcatccttatccgcgatgagaagatttatctggctattttcaatccacgtaataagccggcgaagacagtcattagcggacatgatgtctgcaactcggaaacagattataaaaagatgaactattatttattaccgggggctagcaagactttaccccatgtgttcattaaatctcgcttgtggaacgagagccacggaatccccgatgagatccttcgcggctatgaattaggcaaacatcttaaaagtagcgtaaactttgatgtggaattctgctggaagcttatcgactattacaaagaatgtatctcatgttacccaaattataaggcatataattttaagttcgctgacaccgagtcatacaatgatatcagtgaattttatcgcgaagtggaatgtcaagggtataaaattgattggacctatatttcaagtgaggacgtggagcaactggatcgcgacggtcagatctacttatttcagatctacaacaaggactttgcgcccaatagtaaggggatggataatttgcacaccaagtacctgaaaaacattttttcggaggacaatttgaaaaatattgtcattaaacttaatggagaggccgaactgttttaccgcaaatctagtgttaaaaagaaggttgagcataaaaaaggtactattttagtgaataaaacatacaaagtagaagacaatacggaaaacagcaaagagaagcgtgtaatcattgaaagtgtaccggacgactgctacatggaacttgtggattattggcgcaatggtggcatcggtatcttatcggataaagctgtgcagtataaggacaaggtttcccattatgaggcgactatggatatcgttaaagatcgccgttacactgtagacaagttcttcatccatttgccgattactattaactttaaggcggacgggcgcatcaacattaacgaaaaagtacttaagtacatcgctgagaacgacgagcttcacgtcattggtattgaccgtggagaacgcaatttattatatgtatcagtaattaataagaaaggaaagatcgtcgaacaaaaaagtttcaatatgatcgagtcatacgaaacagtcacgaacattgtgcgtcgctacaattataaggataaacttgtgaataaggaaagcgcacgtacagacgcccgcaaaaactggaaggaaatcgggaaaattaaagaaatcaaggaaggatacctgtctcaagttattcacgaaatttccaaaatggtacttaaatacaatgctattatcgtcatggaggatttgaattatggctttaagcgcggacgctttcgtgttgaacgccaagtataccagaagttcgaaaatatgttaatctctaaattggcatacctggtggataagagccgcaaggccgacgaaccaggaggggttctgcgtggataccaattaacatatattccggatagtctggagaaacttggatctcagtgcggtatcattttttatgttccggcagcttatacctcaaagatcgatccgctgacaggatttgtcaacgtatttaattttcgcgaatattctaatttcgagactaaattagactttgtccgttcgttagattctatccgttacgatactgaaaagcgtctgttctctatttctttcgactacgacaactttaaaacgcataatacgacgcttgccaagaccaaatgggttatctatttacgtggagagcgcatcaaaaaagagcacacatcttacggatggaaggacgatgtatggaacgtcgagtcgcgcatcaaggacttgttcgactcaagtcacatgaagtacgacgacggacataacttgattgaggacatccttgagctggagtccagtgtacaaaagaaattaatcaatgagctgatcgagatcattcgcttaacagttcagttgcgcaactccaaaagcgagcgttatgaccgcaccgaagccgagtacgaccgtattgtatcacccgtgatggacgagaagggccgcttctacgacagcgaaaattacatttttaacgaggaaactgagcttcccaaggatgccgacgccaacggtgcttactgtatcgccttaaaggggttatacaacgtcattgcgattaaaaataactggaaggagggtgagaagtttaaccgtaagttattatcgcttaacaactataattggtttgattttattcagaaccgtcgcttttaa

SEQ ID NO: 105 - DNA, 3867 bp, Artificial Sequence
  Description of Artificial Sequence: Synthetic polynucleotide
atggtgggtaataaaatttccaactctttcgacagtttcaccggaatcaacgctttgtccaagacattgcgcaatgaattaatcccttcagattacacaaagcgccacattgccgaaagcgacttcatcgctgccgatacaaataaaaacgaagatcagtatgtagcgaaagaaatgatggatgattactatcgtgacttcatcagcaaggttctggataatctgcatgatatcgagtggaaaaatttatttgaacttatgcacaaagctaagatcgataaatccgatgcaacgtcgaaggagctgatcaagatccaggacatgctgcgcaagaagattgggaaaaagttctcacaagacccggaatacaaagtaatgttgtcagcaggaatgatcactaaaattctgcccaagtacattttagaaaaatacgaaaccgaccgcgaagatcgtttagaggcaatcaagcgcttctacggctttaccgtatatttcaaagagttctgggctagtcgccaaaatgttttctctgataaggctatcgcctcatcgatttcatatcgcatcatccacgaaaatgcaaagatttatatggacaacctggacgcttataatcgcatcaagcagatcgcttgcgaggagattgaaaagatcgaagaagaggcatatgtatttttacaaggggaccagttagatgtggtctacacagaagaagcatatggacgcttcatctcccaatcagggattgacctgtacaacaatatttgcggtgtgattaacgcacatatgaatttgtattgccagtccaagaagtgttcccgcagtaaattcaagatgcagaaattgcataagcagatcttatgcaaagccgagacgggttttgaaatccccctgggcttccaagatgacgcacaggtcatcaacgccatcaattcatttaatgcccttatcaaggagaagaatatcatctctcgtttacgcactatcgggaaaagtatctcactttacgacgtcaacaagatctatatttcgagtaaagcgttcgaaaatgtgtcagtgtatatcgaccataaatgggatgtgattgcctcatcactgtacaagtacttcagcgagattgttaaaggaaataaggataatcgcgaggagaagatccagaaagagatcaagaaagtcaagtcatgcagtcttggagacttacaacgccttgttaattcgtattacaagatcgattccacctgtcttgagcacgaagtcacggagttcgtaacaaaaatcatcgacggcatcgacaatttccaaattacagactttaaattcaatgacaagatcagtttaattcagaatgagcagatcgtgatggacatcaaaacatatctggataagtacatgtcaatttatcattggatgaagtcatttgtaatcgatgagctggttgataaagacatggaattctattctgagttagacgaacttaacgaagatatgtccgagattgttaacttatataacaaggtccgtaactacgtcacacagaagccctattcacaggaaaaaattaagttgaatttcggatccccgactttggctgatggctggtccaagtctaaagagttcgacaacaacgcgatcatcctgattcgcgatgagaagatctatctggcaatctttaacccccgcaacaagcccgcaaaaacagtcatctccggccatgacgtctgtaattcggagacggattacaagaagatgaattattatttgttgccgggtgcctccaagacgttgccacacgtttttattaaaagtcgcctgtggaatgagtctcatggtattccggatgaaattttacgtggctatgaactgggcaaacatcttaaatcttcggtaaacttcgatgtggaattttgctggaaacttattgattactataaggaatgcatctcttgctatccgaactacaaagcttataacttcaaattcgcggacacagagtcttacaacgatatttcagagttttatcgcgaggtggagtgtcagggttacaagattgactggacgtatatctcgtctgaggacgtagaacagttggatcgtgacggacagatttacttgtttcaaatttacaacaaggactttgctcccaacagcaaagggatggacaacctgcacacgaagtatttaaaaaatatctttagcgaggacaatctgaaaaatatcgttattaagttaaatggcgaggctgagctgttttatcgcaaatcgtcggttaagaaaaaagtagaacacaaaaaaggtactatcttagtgaataagacatataaagttgaggacaacaccgaaaactcaaaagaaaagcgcgtaatcattgagagtgtgccagacgattgctacatggaattggtagactactggcgtaacggaggcatcggaatcctgagcgataaggctgtacaatacaaagacaaagtgtcacattacgaagcaacaatggatatcgttaaggatcgtcgctatacagttgataagttctttattcatctgcctattaccattaattttaaggctgacggtcgtatcaatatcaacgaaaaggtccttaagtatatcgctgagaatgacgaacttcacgttatcggtatcgatcgtggagagcgtaacttattatacgtgtcagtaattaataagaaaggaaagatcgtggagcaaaaatcgttcaatatgattgagtcctatgagaccgtaactaatattgttcgccgttacaactacaaggataagttagtaaataaagaatctgctcgcacggacgcccgcaaaaattggaaagagatcggaaagatcaaggaaatcaaagaaggttatttaagccaggtcatccacgaaatttcaaagatggtccttaagtataacgccattatcgttatggaggaccttaactacgggttcaagcgcggccgctttcgtgtagaacgtcaagtttatcaaaagttcgagaacatgcttatcagcaaactggcgtatctggttgacaaaagccgtaaagcggatgagcctggtggtgttcttcgtggttatcaattgacttacattcccgattccctggaaaaacttggtagccagtgtggtattattttctacgttcctgcggcctacacgtcaaagatcgacccccttacaggttttgtcaacgtttttaactttcgcgagtattcaaactttgaaacaaagttagactttgtacgcagcttagatagcattcgttatgatacggaaaaacgtttgttcagcatcagctttgactatgacaattttaagactcataacacaacattagcgaaaacaaaatgggttatttatcttcgtggcgaacgtatcaaaaaggagcatactagctatgggtggaaggatgacgtgtggaatgtggaatcgcgcatcaaagacttgttcgatagttctcacatgaagtatgacgacggtcacaatcttatcgaagacattctggagctggagtctagcgtccaaaagaaacttatcaatgagttgattgagatcattcgcttaactgtacagcttcgtaattctaaatcggagcgctacgaccgtacagaagctgagtacgaccgcatcgtcagtccagtgatggatgaaaaggggcgcttttacgactccgagaattacatttttaatgaagagactgaacttccaaaggacgcggatgcaaacggggcttattgtattgcactgaagggattatacaacgttattgccatcaagaataattggaaggagggcgagaagtttaaccgcaaattgttgtctttgaataattacaattggttcgattttattcaaaatcgccgtttctaa

SEQ ID NO: 106 - DNA, 3867 bp, Artificial Sequence
  Description of Artificial Sequence: Synthetic polynucleotide
atggtaggcaataaaatctcgaattcattcgattcctttactgggatcaacgcgttatcgaaaacattgcgcaatgaacttatcccgtcagattacaccaaacgtcatatcgcagagtcggattttatcgccgctgacacaaataaaaacgaggaccagtatgtggctaaagagatgatggacgactactatcgtgatttcatctccaaggtattagataaccttcatgacattgagtggaaaaacttgtttgagctgatgcacaaagcaaagattgacaaatcggacgcaacttcaaaggagcttatcaaaattcaggacatgttgcgcaagaagatcggaaaaaagttcagtcaggacccagaatacaaagtgatgttgtcggctgggatgattacaaaaattttaccgaagtacatcttggaaaaatatgagacagatcgcgaagatcgccttgaagcaattaagcgcttctatggattcacggtttactttaaggagttctgggcttctcgccaaaatgtgttttcggataaagcgattgccagcagtatcagttaccgcatcatccacgaaaacgccaaaatttatatggacaacctggatgcttataaccgtattaagcagattgcctgcgaagaaattgaaaaaatcgaggaggaggcatacgtattcttacaaggtgatcaacttgacgttgtgtatacagaagaggcgtacggtcgtttcatctcgcaaagcggcattgacctgtacaataacatctgcggtgtgattaacgctcacatgaatctgtactgtcagagcaaaaagtgctcacgttcaaagttcaaaatgcaaaaattgcataaacaaattttatgcaaggcagagacggggtttgaaatccctctgggattccaggacgatgcacaggtaattaatgcaatcaactcgtttaacgctctgattaaagagaagaacattatctcacgtttacgcacgatcgggaaatctatctccttgtatgacgtcaacaaaatttatatctcttcaaaagctttcgaaaatgtgtcggtctacattgaccataagtgggacgttatcgcgagttcattgtacaaatatttcagtgagatcgttaagggaaacaaggacaatcgcgaggaaaagatccagaaagagattaagaaggtaaagagttgtagtttaggcgatttgcaacgtctggtcaactcatattataagatcgatagtacatgcttagaacatgaagtaacggagttcgtgactaagatcatcgatggaattgataactttcagattacagacttcaaattcaatgacaaaatctcgttaatccaaaacgaacagattgttatggacatcaaaacgtatttagacaaatacatgtcaatttatcattggatgaagtctttcgtgatcgacgagttagttgataaggatatggaattctattctgagttagatgaattaaatgaagacatgagcgaaattgtgaacttatataataaggtccgcaactatgtgacacagaagccctactcacaggaaaagattaaattgaacttcgggtcgccgacattagccgacggttggtcaaaatcaaaggaattcgataacaatgccattattttaattcgtgatgagaaaatctacctggcaatttttaatccccgcaacaaacccgcaaaaactgtaatcagtggccacgatgtatgcaactccgaaacagattacaagaaaatgaattattatttactgccaggggcgagcaaaacccttccacacgtatttatcaaatcccgcttatggaacgagagtcatgggattccagatgaaatcctgcgtggctatgagctggggaagcacctgaagtcctctgttaactttgatgtcgagttttgttggaaactgattgactactataaggagtgcatctcctgctacccaaactataaggcttacaattttaaattcgccgacacggagagttacaacgatatttccgagttctatcgcgaagtggagtgtcagggatacaaaattgattggacttatatctcctcagaggatgtagaacaattggaccgcgatggccagatctacttatttcaaatttacaataaggattttgccccaaactcgaaggggatggacaatctgcacacaaaatacctgaagaatattttctcggaggacaacttaaaaaacattgtaattaaattaaacggtgaggcagaactgttttatcgtaaatcaagtgttaagaagaaagttgagcacaaaaaagggacaattttagttaataagacgtataaagtcgaagacaacacggaaaactccaaggaaaaacgtgtaattattgagtcggtccccgatgattgttacatggaattggttgattactggcgtaatggcgggatcggcatcttgtcagacaaagctgtccaatacaaggacaaagtgtctcattatgaagccacgatggacatcgtaaaggaccgtcgctatactgtcgacaagttttttattcacctgccgatcacgattaattttaaagcagatggccgtatcaacattaatgagaaagtcctgaagtacatcgcagagaacgatgaactgcacgtcattggaatcgatcgcggagagcgtaatttattatatgtttctgttatcaacaaaaagggcaaaatcgtggagcagaaatcgttcaatatgattgaatcttacgagacggtaacaaacattgtacgccgttacaattataaggacaaattggtaaataaagagagcgcacgtaccgacgctcgcaaaaattggaaagaaattggtaagatcaaggaaattaaggaaggctacctgtcgcaagtaatccatgaaatctcgaaaatggtattaaagtacaacgcgattatcgttatggaggacctgaactatggtttcaagcgcggacgctttcgtgttgagcgtcaggtctaccaaaagttcgagaacatgttaatttctaaattagcatacttggttgacaagtcccgtaaagcggatgagcccggtggagtacttcgcgggtatcaattaacctacatcccagacagtttagagaaactgggcagccagtgtggtattatcttttacgttcctgccgcgtacacctctaagatcgacccccttaccggttttgtcaatgtcttcaactttcgcgagtattcaaatttcgaaaccaaattagatttcgttcgcagcttggacagcattcgttacgataccgaaaaacgccttttctctatctctttcgattacgataattttaagacacacaatactactctggccaaaacaaagtgggtgatctacttacgcggagagcgcatcaaaaaggagcatacgagttacggatggaaggatgatgtgtggaacgtagaatcgcgtattaaggatttattcgacagttcccatatgaagtatgatgatggacacaacttgattgaagatattcttgaactggagtctagcgtacagaaaaagctgatcaacgaacttattgagattatccgtttgaccgtccaacttcgcaactcgaagtcggaacgctacgaccgtactgaagccgaatatgaccgtattgtgtcccctgtcatggacgagaaggggcgcttttacgactctgagaattatatcttcaatgaagagacagagttgccaaaagatgcagatgccaatggggcttactgtattgcactgaaggggttgtataatgtcatcgctatcaagaataattggaaagagggggaaaagttcaaccgtaaacttcttagtcttaacaattacaactggtttgacttcattcaaaaccgtcgcttttaa

SEQ ID NO: 107 - DNA, 3738 bp, Ruminococcus sp.
atgcaagagcataaaaaaatatcgcatcttacacacagaaattcagttcaaaaaacaattaggatgcaactgaatcctgtaggtaaaacaatggattattttcaagcaaagcaaattcttgagaatgatgaaaagcttaaagaggactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttgatgaatgtgcatcggaattaaggaaagaaatcgtcaaaaattttaagaatagagatgagtataacaaactattcaataaaaagatgattgagatagttcttccccagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaagctatccaaaaacgcagttgatgatttagataccacttattccggcttatgcggtacaaatttgtatgatgtttttacagttgattattttaactttttgcttccacaatccggaattaccgaatataataaaatcatcggcggttacacaacaagcgacggtacaaaagttaagggtattaacgaatatataaatttgtacaatcaacaagtatccaaacggtataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaatgatgaaatcagagaaaagtctatcgtagattactacaagacttctttaatgcaacttaccgacaatttatcagacaaatacaaagaagcagcacctctgttcaacgaaagttacgctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggcaattcacagctattaaacggctgggatcgaaacaaagaaaaagactgcggtgccgtttggctttgtaaagatgaaaagtattatcttgcaatcatagataaaagtaataatagtattttggaaaatattgattttcaagactgcgatgaaagcgattgttatgaaaagataatttacaagcttctccccggtccaaataaaatgcttccaaaagttttcttttcagaaaagtgcaagaaacttttgtcaccgtcagacgaaatacttaaaattcgtaaaaacggcactttcaaaaaaggtgataagttcagccttgatgattgccataagttaattgatttctacaaagaatcattcaaaaagtacccaaattggttaatttataactttaaattcaaaaaaacaaacgaatataatgatatcagcgaattttataatgatgttgcttcacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaagagcaagcacttttccttatgacttaatcaaagataaacgctacactaagtggcagttttcacttcacttccctattaccatgaattttaaagctccggatagggcaatgatcaatgatgatgtcagaaatctgctgaaatcctgcaacaacaatttcatcataggaattgacagaggcgaaagaaacttgctttatgtcagcataattgacagcaacggtgctataatatatcagcactcactcaatattatcggaaacaagtttaaaggaaaaacatacgaaactaactaccgggaaaaacttgaaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgatgaagaaggcggtttacttcatgcctaccagcttacgaacaagcttgagagctttgataagcttggcatgcaaagcggttttattttctatgttcgtcctgattttacaagcaaaattgatcccgttaccggctttgtaaatttgttgtatcctcgatacgaaaacattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaagcaataacgaatggagttatcgtacaataattcttgcagaaaaatttaaagaattatttgataacaattctataaattatcgtgattctgacaatttgaaagctgaaattctttcacagacaaagggcaaattttttgaggatttcttcaaattattaagacttaccctacagatgcgaaacagtaaccctgaaacaggcgaggaccgtattctttctcccgtcaaggacaaaaacggtaatttttacgacagttcaaaatatgacgaaaagagcaatcttccgtgtgatgccgatgcaaacggtgcgtacaacattgcccgcaaaggtttgtggattgttgaacaattcaaaaaatccgataatgtttcaactgtcgaaccggtaatccacaatgacaaatggctgaaatttgttcaggagaatgatatggcgaataattaa

SEQ ID NO: 108 - DNA, 3738 bp, Artificial Sequence
  Description of Artificial Sequence: Synthetic polynucleotide
atgcaggaacacaaaaagatcagtcacttgacccatcgcaactcggtgcagaagacgatccgcatgcaattgaacccagtcggtaagacgatggactactttcaggctaaacagattcttgagaacgacgagaaattaaaggaagattaccaaaaaatcaaggagattgcagaccgcttctatcgcaatttaaacgaggatgtactgtcgaagactgggttggacaaacttaaggattatgctgaaatttattatcactgcaatactgatgccgaccgcaaacgtctggatgaatgcgcttccgagctgcgtaaggaaattgtaaaaaattttaagaaccgcgacgagtataataagctttttaataaaaaaatgattgaaatcgtattgccccagcacttaaaaaacgaagacgaaaaagaagtggtcgcttctttcaaaaatttcacaacctatttcacgggtttttttacaaatcgcaagaatatgtattctgacggggaagaatcgacggcaattgcttaccgctgcattaacgagaacttgcccaaacacttagacaacgtaaaggcttttgagaaagcgattagcaaactgtccaagaacgcagttgatgatctggacacaacctatagcgggttatgtggcacaaatctttatgatgtttttacggttgactactttaattttttacttccgcagtccggtattacggagtataacaagatcatcggagggtacacgactagcgatggcaccaaggtaaaagggattaacgagtacattaacctttacaaccaacaggttagtaaacgttataagattccgaatctgaagattctgtataagcaaatcctgagtgaatcagagaaagtatcgtttatcccgccaaagtttgaagatgataacgagcttctttccgccgtctccgagttctatgcaaacgatgagacttttgacgggatgccgcttaaaaaagccattgatgagacgaagcttttgtttgggaacttggacaattcgtcgcttaatggcatttatatccaaaacgaccgtagtgtcacgaacctgtcgaattcaatgttcgggtcttggtctgtaatcgaagatctttggaacaagaactatgactcagtaaatagcaatagtcgcattaaagatattcagaagcgtgaagacaaacgcaagaaagcgtataaagccgaaaaaaaattatctcttagctttcttcaagtcttaatctcaaatagcgagaatgatgagatccgtgagaagtctattgtagattactataagacgagtttaatgcaattaactgataacctgtcggataaatataaggaagctgcgccattatttaatgagtcctacgcaaatgagaagggcttgaaaaatgacgataagtcaatctcattgattaaaaattttttagatgccatcaaagaaattgaaaaattcattaaaccattaagtgagactaatatcacgggtgagaagaacgacttgttctactctcaatttacgcctttattggacaacattagtcgtattgatattctgtacgacaaagtgcgcaactacgtcacccagaagcctttcagcacagacaagattaagttaaatttcggcaactctcaattgttgaacggttgggatcgtaataaggagaaagattgtggtgctgtctggctttgcaaagatgaaaaatactaccttgcaatcattgacaagtctaacaactctattctggagaacatcgattttcaggattgcgatgaatcagattgctacgaaaaaatcatctataagttattacctggaccgaacaaaatgttgcctaaagttttcttttcggagaagtgtaagaagcttctttccccatcggatgaaatcttgaagatccgcaaaaatgggactttcaaaaaaggggataaattctctctggacgactgtcacaaattaatcgacttctacaaggaatcttttaagaagtatcctaattggcttatttataatttcaaattcaagaagacgaatgaatataacgatatctcagaattttataatgacgtcgcttcgcaggggtacaatattagcaaaatgaaaattcccacgtcgttcattgacaaacttgttgatgaaggtaaaatttacttatttcagttgtacaacaaggattttagtccgcacagcaagggcacgccaaatctgcatactctgtatttcaagatgttgtttgatgaacgtaatttggaggacgtggtgtataagcttaacggggaagcggaaatgttctatcgccccgcatcaattaagtatgataagccgacacacccaaaaaacacccccattaaaaacaaaaacacgttaaacgataaacgtgcttcgacattcccctacgacttgattaaagacaagcgctatactaaatggcaatttagccttcactttccaatcactatgaacttcaaagctcccgatcgcgccatgattaacgacgacgttcgcaatttacttaaaagctgcaataacaactttatcattgggattgaccgcggcgaacgtaatctgttatatgtctcaatcatcgattctaatggcgcaatcatttatcaacacagcttgaatatcattgggaataagtttaagggtaaaacctatgaaacaaactatcgcgagaaacttgaaacgcgcgagaaagaacgcacggagcaacgccgcaactggaaagccatcgagtccatcaaagaattaaaggagggatacatctcgcaagctgtacatgtgatttgccagcttgttgtgaagtacgacgcaattatcgtgatggagaaattgacagatggattcaagcgcggtcgtactaagtttgaaaagcaagtgtaccaaaaattcgaaaagatgcttatcgataaacttaattactacgtagataaaaaactggaccccgatgaggaaggggggttgctgcacgcatatcaactgacaaacaaattggagtctttcgataagttaggtatgcaatcgggcttcatcttttatgtacgcccggacttcactagcaaaattgaccctgtaaccggcttcgtaaaccttctttatcctcgctacgaaaatattgataaagcaaaggatatgattagccgtttcgacgacattcgctacaatgcgggtgaagacttttttgaatttgacattgattacgacaaatttcccaagacggcctccgattaccgcaaaaaatggactatctgcactaacggagaacgtattgaagcatttcgcaacccggcctccaacaatgagtggagctaccgtaccatcatccttgccgaaaagttcaaagaattatttgataataattcgatcaactatcgcgattcggataacttgaaagctgaaatcctttctcagaccaaaggaaagttttttgaagactttttcaaattgttgcgtctgacattacagatgcgcaatagtaatcccgaaacgggcgaagaccgcattttaagtccggttaaggataaaaacggcaatttctacgatagctctaagtatgacgagaaatcgaatttaccatgtgacgcagatgcaaacggtgcgtataacatcgcgcgtaaaggtttgtggattgtcgagcagtttaaaaagtctgacaacgtttctacggtagaaccggttatccataatgataagtggttaaaatttgtacaggagaacgacatggccaacaactaa

SEQ ID NO: 109 - DNA, 3738 bp, Artificial Sequence
  Description of Artificial Sequence: Synthetic polynucleotide
atgcaggaacataaaaagattagtcacctgacccaccgtaattctgtacaaaagaccattcgcatgcagttaaatccggtaggcaagacaatggactactttcaggcgaaacagattttagagaacgacgagaaattaaaagaagactatcagaagatcaaggaaattgctgatcgtttttaccgtaatcttaatgaagatgtcttgagtaagacgggtcttgacaaattgaaggactatgctgagatttattatcattgcaatactgatgccgatcgtaaacgtttggatgagtgtgcgtcggagttgcgcaaggagattgtcaagaattttaaaaaccgcgatgaatacaacaagttgttcaacaagaaaatgatcgagattgtgctgccgcaacaccttaaaaacgaagacgagaaggaggtcgtagcatcctttaagaactttactacatactttaccggcttcttcacgaatcgcaaaaacatgtactccgacggtgaagaatccacagctatcgcttaccgctgcattaacgaaaatttaccgaagcatctggacaatgtcaaagcattcgaaaaggccatcagcaaactttcgaagaacgcggtggacgacttagatacgacatactcaggcttgtgtgggacaaatttgtacgacgtcttcacggtggattacttcaatttcctgctgcctcagagtggcattaccgaatataataaaattatcggtggttacacgacctcagacggcacgaaagttaaggggatcaatgaatatattaatttgtacaatcaacaagtgtcgaagcgttacaaaatcccaaatcttaagatcttgtataagcagatcctttctgaatctgagaaagtttcgttcattccgccaaagttcgaggatgacaacgagttgctgtcagcggtgtccgaattttacgcgaatgacgagacgttcgacgggatgccgttgaaaaaagcaattgatgagacaaaacttcttttcgggaatctggataatagttctctgaatggcatttatattcagaacgaccgctctgtgaccaatttgtccaattcaatgtttgggtcatggtcagtgatcgaagacctttggaacaagaactatgattcagttaattccaactctcgtattaaggatatccaaaagcgcgaagataaacgcaaaaaggcttacaaggcggagaagaagttgagcctgtccttccttcaggtgttgatcagtaacagtgagaacgatgaaattcgcgagaaatctattgtagactactataagacttctttgatgcaactgaccgataacttatccgataagtataaggaagcagcgccacttttcaacgagagttatgcgaacgagaaaggcctgaagaatgacgataagtcgatttcattgatcaaaaatttcttggacgcgatcaaagagattgaaaaatttattaaaccgctgtccgagactaacatcaccggcgagaaaaatgacttgttttattcccagtttacgcctttgctggacaacatctctcgcatcgacatcttatacgataaggtgcgcaattacgtaacgcaaaagccattctcgacagacaaaattaagctgaacttcgggaacagccagttacttaacggttgggatcgcaataaagagaaggattgcggcgcggtgtggttgtgtaaagacgagaagtattatcttgcgatcattgataaatcgaacaacagtattttggagaacatcgatttccaggactgtgatgaaagtgactgctacgaaaagatcatttataaactgttaccaggccccaataaaatgcttccgaaggtttttttcagcgaaaaatgcaaaaagcttttgtccccaagtgacgaaattcttaagattcgtaaaaacggtactttcaaaaagggcgataaattcagcctggatgactgccacaagctgatcgatttttataaagaatccttcaaaaaatacccaaactggttaatttataactttaagttcaaaaagacaaatgagtacaatgatatctccgagttttataatgatgtagcgtcccagggatacaacatctcaaaaatgaaaatccccactagctttatcgataaattagtcgatgagggtaaaatttatttatttcaattgtataacaaagattttagcccgcattcgaaaggtacgcctaatcttcacaccctttattttaaaatgctttttgacgaacgtaaccttgaggatgttgtatacaaattgaacggagaggcggagatgttttatcgccccgcgtccattaaatatgacaagccgacgcacccgaaaaacacaccgatcaaaaacaagaacactttaaacgataaacgcgcgtcaacgtttccttacgacctgattaaagataaacgctacactaagtggcagttctccttgcacttcccgatcactatgaactttaaggcacccgatcgcgcaatgatcaacgatgatgtccgcaatctgttaaagagctgcaacaataatttcatcattggaattgaccgcggtgagcgtaatcttttatacgtgagcattattgactccaacggcgcgattatctatcaacactctttgaatatcattggcaataaatttaaaggtaagacttacgagactaattatcgcgagaaacttgagacccgtgagaaggagcgtacagaacaacgtcgcaattggaaggctattgaaagcattaaggagttgaaagaaggttacatctcacaggctgtacacgtaatctgtcaattagtcgtcaaatatgatgcaatcattgttatggagaaattgaccgacggcttcaaacgtgggcgtacgaaatttgaaaagcaagtgtaccaaaagtttgaaaaaatgttaatcgacaaactgaattactacgtggacaaaaagcttgatcctgacgaagaaggcggactgctgcatgcttaccaattgacgaataagcttgagagtttcgataaactggggatgcagtccggttttatcttctacgtgcgtcctgactttacctccaaaattgatcctgtaacaggttttgtcaacttgttgtatccgcgctatgaaaatatcgacaaggctaaggacatgatttctcgtttcgacgacattcgttataacgcgggggaagatttttttgaatttgatatcgattatgacaagttccctaaaacagccagcgactaccgcaagaagtggacaatttgtactaacggagaacgcattgaagcgtttcgcaatccagcatctaacaatgagtggtcttatcgcacgatcattctggcagaaaagtttaaggagctgtttgacaacaactcaatcaattaccgtgatagcgataatttaaaagctgagattctgagccagacaaaaggtaagttttttgaggactttttcaaattgttacgtcttacgttacagatgcgcaattctaacccggaaactggagaagatcgtattttgtcccccgtgaaagataaaaacggaaacttttatgacagttctaaatacgatgagaaatctaaccttccgtgcgatgcggacgcaaatggcgcgtataacatcgcacgtaagggactgtggattgtggaacaattcaaaaagtcagataatgtgtctacggtcgaaccggtcatccataacgacaagtggctgaagttcgtccaagaaaatgatatggccaacaattaa

SEQ ID NO: 110 - DNA, 3738 bp, Artificial Sequence
  Description of Artificial Sequence: Synthetic polynucleotide
atgcaggaacataagaagatcagccatttgacacatcgcaacagcgtgcagaagacaattcgtatgcagctgaatcccgtcggcaaaaccatggattatttccaagctaaacagattttggaaaacgatgaaaaattaaaagaagactatcaaaaaatcaaggagatcgcggatcgtttctatcgtaatcttaacgaggacgtcttgtcgaagacaggattagacaagctgaaagactatgcagaaatctattatcactgcaataccgacgcagatcgtaaacgcctggatgaatgtgcttctgagcttcgcaaggaaatcgtcaagaacttcaagaaccgcgatgagtataataagttgtttaacaagaagatgattgaaattgtattgcctcaacacttgaagaacgaggatgagaaagaggtcgtcgcttccttcaaaaactttactacatatttcacaggattcttcaccaatcgcaagaatatgtattctgatggtgaggagtcaacggcgattgcctaccgttgcatcaatgagaacctgccgaaacacctggacaatgtgaaagcgtttgaaaaagccatttctaagctgagtaagaacgcagtcgatgaccttgacaccacctattcaggattatgcggaactaatttatacgacgtcttcactgttgattactttaattttcttttgcctcagagcggaatcactgagtacaacaaaattattggaggatacacaacttctgacggcaccaaggtaaaggggattaacgaatatatcaatctttataatcagcaagtgtctaaacgctacaaaatcccaaacttgaagatcttatacaagcagatcctttcagagtcggaaaaggtttcgttcatccctccaaagttcgaggacgataatgagttgttgtcggctgtatcggagttttatgccaatgatgagacgtttgatggtatgcctcttaagaaggcaattgacgaaacaaagttgctgtttggcaatttggacaatagtagtcttaatgggatctatatccaaaatgaccgctcagttacgaaccttagcaactctatgtttggctcttggtctgttattgaagacctgtggaacaaaaattacgattcggtgaactcaaattcgcgtatcaaggatattcaaaagcgcgaggacaagcgtaaaaaagcgtacaaggcggaaaagaagttgtcactttcgttccttcaggtccttatctcaaactccgaaaacgacgaaattcgcgaaaagtcgatcgtcgattactataaaactagccttatgcagttaacggataatctgtctgacaagtataaagaggcagcacctctgtttaacgagagctacgcgaatgaaaagggtcttaagaacgatgataagtccatttcgttaattaagaattttttagacgctattaaagagatcgagaaatttatcaagccactttcagagactaatattacgggtgagaaaaatgatctgttctattcacaattcacgccgctgttggataacatttcgcgcattgatatcctgtatgataaagtgcgtaactacgtgacgcagaaaccattttcgaccgacaaaatcaaattaaacttcggtaactcgcagttgctgaatggttgggatcgcaacaaggagaaagactgtggcgctgtatggctttgcaaagacgaaaaatattacttggcaattatcgacaaatctaataattctatcttagaaaacatcgacttccaagattgtgatgaatcggattgttacgagaaaattatttataagttattacctggtccaaacaaaatgctgcccaaggtttttttttccgaaaaatgtaagaagctgttaagtccaagtgatgaaatcttgaaaatccgcaaaaacggcactttcaaaaagggagacaagttctcactggacgattgccacaaactgatcgatttctacaaggagtctttcaagaaatatccgaattggttgatttacaactttaaattcaagaaaacaaatgagtataacgacatcagcgagttttataatgatgtcgcctcgcaaggttacaacatttcaaaaatgaagatcccaacgagcttcatcgataaacttgtagatgaaggaaaaatttacctgtttcaattatacaacaaagacttcagcccgcattcgaagggaacccccaaccttcatacgctgtatttcaagatgttattcgatgaacgcaacttagaagatgtggtctacaaattaaacggagaagcagaaatgttctaccgccccgcgtcgattaaatatgacaagcccacgcacccgaagaacactccaattaagaataagaacactctgaatgacaagcgtgcttctacgttcccctatgatttaattaaagacaaacgttatacgaagtggcagttttctttacacttccctatcacaatgaattttaaagcccccgatcgtgctatgatcaatgatgacgtgcgtaacttgttgaaatcctgcaacaataatttcattatcggtattgaccgtggcgagcgcaatctgctttacgtcagcattattgattcgaatggcgccatcatttatcagcactcgctgaacatcatcggtaataagtttaagggaaaaacttatgaaactaattaccgtgagaagctggagactcgtgagaaggagcgcacggagcagcgtcgcaattggaaagcaattgagtcgattaaggagcttaaggagggttacatcagccaagcagtccacgtgatttgccaactggttgtgaaatacgacgccatcattgtcatggagaaattaacagatgggtttaagcgtggtcgtactaagtttgaaaaacaagtatatcaaaaattcgagaaaatgctgatcgacaaattgaattattacgttgataagaaattggatccggacgaagagggaggccttttacatgcatatcaactgacaaataaactggaatccttcgataaattggggatgcagagtggatttatcttttatgtgcgtcctgacttcacatccaaaattgaccctgtgactggcttcgttaatttattatacccgcgttatgagaacattgacaaagcaaaagatatgatttcgcgctttgacgatattcgctacaatgccggagaggatttttttgagtttgacatcgactacgacaaattccctaagacggcgagtgactatcgcaaaaagtggactatttgtacaaacggcgagcgtatcgaggcgttccgcaatccagcctcgaataatgaatggtcgtaccgcacgatcatcctggctgaaaaattcaaggaattatttgacaataatagtatcaactaccgcgattccgataatcttaaagctgagatcttatcccagacgaaaggaaaatttttcgaggactttttcaaactgctgcgccttacgttgcaaatgcgcaattccaaccctgaaaccggcgaagatcgcattctgagccccgtaaaagataagaatggcaatttctacgactcttcgaagtacgacgagaaatctaaccttccctgtgatgcggacgctaatggtgcatacaacattgctcgcaaaggactgtggattgttgagcaatttaagaagtcggacaacgtaagtaccgttgaaccggtgattcataacgacaagtggctgaaattcgtgcaagaaaacgatatggccaacaactaa

SEQ ID NO: 111 - DNA, 3816 bp, Leptospira sp.
atgaagaatctcgcaaactttacaaatttatacagcttacagaaaacacttcgttttgaactaaaaccaattggaaaaactttagactggatcatcaaaaaggatcttttgaagcaggatgagattcttgcagaagattataaaatagtcaaaaagattatagatcgttatcataaagatttcatagaccttgcatttgaatccgcctatctacaaaagaagtcctccgattcctttaccgcgatcatggaagcatctatccaatcgtattctgaactttattttataaaagaaaagtctgacagagataagaaagccatggaagaaatttccggaataatgcgaaaagaaatagtagaatgttttactggaaagtatagcgaagttgttaaaaagaaatttggcaatcttttcaaaaaagagcttatcaaagaagatttactgaatttttgcgaaccagatgaattacctatcatccaaaagtttgcggacttcactacctattttactggatttcatgaaaatcgggagaatatgtattctaatgaggagaaagcaacagctattgccaatcgactcatccgcgaaaacctaccgagatatctagataacctaaggatcattcgatcaatccaaggcagatacaaagattttggttggaaagatttagaatccaatctgaagcggattgataaaaatctccaatattcggatttccttacagaaaatggctttgtgtacactttttcccaaaaaggcatagaccggtacaatttgatcctgggagggcaatcggtcgagtcgggagagaagatacaaggacttaatgaacttatcaatttgtatagacaaaagaatcaattggatagaagacaacttccaaatttaaaagaactgtataagcagatacttagtgatcgaactagacattcttttgtaccagagaagttttcatctgataaagcactgttgcgatctcttctggattttcacaaagaagtgattcaaaataaaaatttatttgaggagaagcaggtaagccttttacaggcaatcagggagacacttactgatttaaaatcctttgacctagataggatatatttaacaaacgacacaagtctcactcaaatttcaaattttgtatttggtgattggtcaaaagttaagacaatactagcaatctatttcgatgaaaacatagctaatcctaaagacagacaaaggcaatcgaattcatatctaaaagcaaaggagaattggctcaaaaaaaattattattcaatacacgaattgaatgaggcaatttcggtatatggaaaacattctgatgaggaattgcctaacacaaagatcgaagattatttctctggtcttcaaactaaagatgagactaaaaagccaatagatgtactcgatgcaattgtctctaaatatgctgacttagagagtttgcttacgaaggaatatcctgaagataaaaatttaaaatcagataaaggtagtatcgaaaaaatcaagaactacctagattcgattaaactattacaaaattttttaaaacctctaaaaccaaagaaggttcaggatgaaaaggatttaggcttctacaatgatcttgaactttatctggaatcactagaatcagctaatagcctttacaataaggtgcgaaactatctaactggaaaagaatactcagatgaaaaaatcaaattaaattttaagaactctacacttcttgatggatgggatgagaacaaagaaacatcgaatttgagtgttatcttccgagataccaacaattattatttagggatactggataaacaaaacaatagaatttttgaatcaataccagaaatccaatctggggaagaaacgatccaaaaaatggtttataaattacttccgggcgcaaataatatgcttccaaaagtattcttttcagaaaaaggattattaaaatttaatccttctgatgaaattacctcattatattctgaaggcagatttaaaaaaggagataaattcagtatcaattcactccatacactcatagatttttataagaaatctttggcagtgcatgaggattggagtgtttttaatttcaaatttgatgaaactagtcattatgaagatatctcacaattttatagacaagttgaatcacaagggtataagataacattcaaaccgatttcaaaaaaatatattgatactttggtagaagacggtaaactatatctctttcagatttacaataaggacttttctcaaaataaaaaaggtggcggaaaacctaatttacataccatttactttaaatctttatttgaaaaagaaaacttaaaagacgttattgttaagttaaacggacaggcggaagtattttttcgcaaaaaatctatacactatgatgagaatatcacacgatacggacatcattctgaactcctaaaaggaagattcagctaccctatccttaaggacaaacgattcacagaagacaaatttcagtttcactttcccatcacactcaattttaaatcaggagaaatcaaacagttcaatgcacgagtaaattcctatctgaaacataacaaagatgtgaagatcattggaattgatcgcggggaacgccacttgctgtatctatctttaatcgaccaagatgggaaaatacttcggcaagaatccttaaacttaataaaaaatgaccaaaattttaaagccataaattatcaagagaaattgcacaaaaaagagatagaaagagatcaggcaagaaaatcgtgggggtccatcgagaatataaaagagttaaaggaaggctatctgtcccaagtggtacatacaatttcaaagttgatggtagaacacaatgccattgttgttctagaagatttaaattttggatttaaacgtggtcgccagaaagtagaacggcaagtctatcagaaattcgaaaaaatgctcattgaaaagctaaattttttggttttcaaggataaagaaatggatgaaccaggaggtatcctaaaagcataccaactaacggataactttgtgagctttgaaaaaatgggaaaacaaacaggttttgttttctatgttcctgcttggaatacaagtaaaatcgatcctaaaacaggtttcgtcaattttttgcatctaaactatgaaaatgtaaaccaagcaaaagaattgatcgggaaatttgatcaaattcgatataaccaagatagagattggtttgaatttcaagttacgactgaccaattctttactaaagagaatgctccagatacgcgtacctggataatttgttcaaccccaaccaaacgtttttattcaaaacgaacagtgaatggttctgtttcaacaatagagatagatgtgaaccaaaagttaaaagaacttttcaatgattgcaattaccaagatggtgaagatttagtagataggattcttgagaaagattccaaagattttttttcgaagctcattgcctatttacgaatccttacatcgcttcgtcaaaataatggtgaacagggttttgaagaaagggattttatactctctccggtggtgggcagtgatggtaaattctttaattcactagatgctagttctcaagaaccaaaggatgcagatgcaaacggcgcctaccatatcgcattaaaaggattgatgaatctacatgttatcaatgaaaccgatgatgaatccttaggtaaaccgagttggaaaattagcaacaaagactggctaaattttgtatggcaaaggccaagcttgaaagcataa

SEQ ID NO: 112 - DNA, 3816 bp, Artificial Sequence
  Description of Artificial Sequence: Synthetic polynucleotide
atgaagaacttagccaactttacgaatttatatagccttcaaaaaactttacgtttcgaattgaagccaattggaaaaacacttgactggatcatcaaaaaagatttgttgaaacaggatgagattctggcagaagattacaaaatcgttaaaaagattattgaccgctaccacaaggattttattgaccttgcattcgagtctgcttacctgcaaaaaaaatctagcgacagctttacggcaattatggaagccagcatccagtcatactctgagttgtattttattaaggaaaagtctgaccgtgacaaaaaagccatggaggaaatctctgggatcatgcgtaaggaaatcgtcgagtgctttacgggtaagtattcggaagttgttaaaaaaaaatttggaaatctttttaagaaggagctgatcaaggaggacttattaaacttttgcgagcccgatgagctgcctattattcagaaattcgcggactttacgacttatttcacaggcttccacgagaatcgcgagaatatgtattccaatgaagaaaaagcaactgcgatcgcaaaccgtctgatccgtgaaaatcttcctcgttatcttgacaacctgcgcatcattcgcagtatccaagggcgttataaagactttgggtggaaggaccttgaaagtaaccttaaacgtattgataagaaccttcagtattccgacttccttactgaaaatgggttcgtctacaccttctcacaaaagggcatcgaccgttataatcttatcttaggaggtcaatcagtggagtccggggaaaaaatccagggccttaacgaacttattaacttgtaccgtcagaagaatcagttagatcgccgtcaacttccgaaccttaaagagttgtacaagcaaattttgtccgaccgcacccgtcacagttttgtcccagaaaagttcagcagcgacaaggcgcttttacgctcacttcttgactttcataaagaagttattcaaaacaaaaacctgtttgaagaaaaacaagtatcgttactgcaagctatccgcgagaccttgaccgacttaaagtcttttgatcttgatcgcatctatttaaccaacgacacatccttgacccaaatttcaaactttgtcttcggcgattggtccaaggttaaaactattttggctatttactttgacgaaaatattgctaatcccaaagatcgtcaacgtcagtccaattcatatttaaaggcaaaagagaattggctgaaaaagaattactatagcattcatgagctgaacgaggcgatttccgtatacgggaaacattctgatgaggagcttcctaacactaagattgaggattacttctccgggttacagaccaaggatgagaccaagaagccaatcgatgtgcttgatgctatcgtatcaaagtatgcagacttggagtccctgcttacgaaagaatatcctgaagataaaaatttaaaatccgataagggttcgattgaaaagattaagaattacttggactcgattaagttgttacagaacttcctgaagcctttgaagcccaagaaagtacaggatgagaaggacttgggcttctataacgatctggaattatacttagagagccttgagtccgccaacagcctgtacaacaaggtacgtaattacttgacagggaaagaatatagtgacgagaagattaagcttaactttaaaaatagcacccttcttgacgggtgggacgagaacaaggaaacctctaaccttagtgtcattttccgcgatactaacaactactacctgggtattttggacaaacagaataatcgtatcttcgaaagcattccagagatccagtcaggcgaggaaaccatccagaagatggtctataaacttcttcccggtgcaaacaatatgttaccgaaagtctttttctccgaaaaaggattgcttaaattcaatccctcagatgagatcacttcattgtattcggaagggcgttttaagaagggtgataaattttcgattaacagcttacacaccctgatcgacttctacaaaaaaagcctggccgttcacgaagactggtccgttttcaactttaagttcgacgaaacttcgcactatgaggatatctctcaattctatcgtcaggtcgaaagtcaggggtacaaaatcacgttcaaacccattagtaaaaaatacattgataccttggtggaggacggcaaattgtacttgttccaaatctacaataaggatttctcccagaacaaaaaaggtggtggcaaaccaaatttacataccatctacttcaagagtcttttcgaaaaggagaatttaaaagatgtcattgttaagttaaatgggcaagcggaggtgttctttcgcaagaagtccattcattacgacgagaatattacgcgctacggacaccatagtgaacttcttaagggccgctttagctacccgatccttaaagataagcgttttacggaggataagtttcagttccactttccgattaccctgaactttaagagcggcgagattaagcaatttaatgctcgcgtcaactcctaccttaagcacaacaaagacgttaagatcattggtatcgatcgcggagaacgtcacctgctgtatttatccttaatcgaccaagatgggaagatcttacgtcaggaatctttgaatcttatcaaaaacgatcagaattttaaggctattaattaccaagaaaagttgcataagaaagagattgaacgcgaccaggcacgcaagagttgggggtcaattgaaaacatcaaggaattaaaggaaggttaccttagccaggtagtgcatacaatctccaagctgatggtagagcacaacgcaatcgttgtattggaagatttaaatttcgggttcaaacgcggtcgccagaaagttgagcgtcaagtataccaaaaattcgagaagatgttgattgagaaacttaactttttagtgtttaaggacaaagagatggacgaaccaggcgggattttaaaagcgtatcaattgactgataacttcgttagttttgagaagatgggcaagcagaccgggtttgtgttctatgtccctgcctggaacacctctaaaattgatccaaagaccgggttcgtcaacttccttcatttaaattacgagaatgttaaccaggcaaaagaattaattggcaaatttgatcagattcgctacaaccaggaccgcgattggttcgagtttcaagttaccacagaccaattcttcaccaaggaaaatgccccagacacccgtacctggattatctgctctactcctacaaagcgtttttactcaaagcgcacggtaaatggttcggtgtcgacgattgagattgatgtaaatcagaagctgaaagaattgtttaatgactgtaattatcaagatggggaggatttagtcgatcgcatccttgagaaggacagtaaggactttttttcgaaacttatcgcgtatttgcgcatcttaacgtcattacgtcaaaacaacggagaacaaggcttcgaggagcgcgactttatcctgagcccggtggttggctcagatgggaaattcttcaattccttggatgctagttcacaggagcctaaagatgcggatgcgaatggagcctatcatatcgctctgaagggcctgatgaacctgcacgttatcaatgagacagatgatgagtcccttggaaaaccgtcttggaagatttccaacaaggattggttaaatttcgtatggcaacgtccaagtctgaaagcttaa

SEQ ID NO: 113 - DNA, 3816 bp, Artificial Sequence
  Description of Artificial Sequence: Synthetic polynucleotide
atgaagaatttagcaaacttcaccaacctttacagcttgcaaaagaccctgcgtttcgaattaaagccaatcggcaagaccctggactggatcatcaaaaaggaccttcttaaacaggacgagattttggccgaagactacaaaattgtaaaaaagatcatcgaccgctaccacaaagactttattgatttggcgtttgagtccgcgtacttacagaaaaagtcatcagatagctttacggctatcatggaggcgtccatccagtcgtattccgagctgtattttatcaaggagaaaagcgaccgtgataaaaaagcgatggaagaaatttcagggatcatgcgcaaggagattgtcgaatgtttcacagggaagtacagcgaagttgtaaagaaaaagtttggtaacttgtttaagaaggagttgatcaaagaggatctgctgaacttctgtgaacctgacgaattacccattatccaaaaatttgcagactttacgacatatttcacagggtttcacgagaatcgtgagaatatgtactcaaatgaagaaaaggcaactgcgatcgctaaccgcttgatccgtgaaaacttaccacgttatcttgacaacctgcgtattatccgctcaattcagggccgctacaaagactttggatggaaggacttagagtcaaatttaaaacgtattgacaagaacttacagtattcggattttctgacggagaatggtttcgtttatactttttcccaaaagggaatcgaccgctacaacttgattttggggggccaaagtgtcgagtctggagaaaagatccaaggactgaatgaacttatcaacttgtaccgccaaaagaatcaactggaccgccgtcagttaccgaacttgaaggagctttacaaacagatcctgagcgaccgcacccgtcattcattcgtgccagagaagttctcgtcggacaaggcactgttgcgcagtttgttggatttccacaaagaggtgatccagaataaaaatcttttcgaggagaaacaagttagcttgctgcaagctatccgtgaaacccttaccgatcttaaatcgttcgatctggaccgcatctaccttacaaacgatacgtcactgacccagattagcaatttcgtatttggtgactggagtaaggtgaagacaattttagccatctacttcgacgagaacatcgcgaatcctaaggaccgccagcgccaatctaactcgtatcttaaagcaaaggaaaattggctgaagaagaattactatagcatccatgaattgaacgaggcgatttccgtatacgggaagcattcagatgaagagctgccgaacaccaaaatcgaagactacttctcggggttgcaaactaaagatgagactaaaaagccaattgatgttttggacgccattgtgagtaagtacgcggaccttgagagtctgttaacgaaggagtatccggaagataaaaacttaaaaagtgacaaaggctcaatcgagaagatcaaaaattacttggatagtattaagctgcttcaaaatttcctgaagccgcttaagcctaaaaaagtacaggacgaaaaagatttggggttttataatgacttggaactttacttagaatcactggagtccgcaaattcactttataacaaagtccgtaattatctgaccggaaaagaatactcagatgagaagatcaagttgaacttcaagaactcaactcttttagacgggtgggacgagaacaaggaaacaagtaacctgtctgttatttttcgtgacacgaacaattattatcttgggatccttgacaagcaaaacaaccgtatcttcgaatccattcccgagatccagagtggcgaggagaccatccagaagatggtctataagttgttgcccggagcgaataacatgcttccgaaagtctttttctctgagaaaggcctgcttaaattcaacccctcggacgagattacgtccctgtactcggagggccgcttcaaaaaaggggataagttttcaatcaattctctgcacacgttaattgacttttacaaaaaatctttagcggtgcatgaagactggtctgtctttaatttcaaattcgacgaaactagtcattatgaagatatttcacagttttaccgtcaggtagaaagccagggatacaaaatcacatttaaacctatctcgaaaaagtatatcgatacgttagtagaggacggcaagctttatctttttcagatttataataaggatttctctcaaaacaagaagggaggcgggaagcctaaccttcacaccatttattttaagtccttatttgagaaagaaaaccttaaggatgttatcgtgaaactgaacggtcaggccgaggtatttttccgcaaaaaaagtattcattacgatgagaacatcacacgttacggacaccattctgagcttctgaaagggcgcttctcctacccaatcctgaaagacaagcgtttcactgaggataagttccaattccatttccctatcacgttgaatttcaaatccggcgaaatcaagcagtttaatgcgcgcgttaactcctaccttaaacataataaagacgtcaagatcattggcattgatcgtggcgagcgccacttactttaccttagtctgattgatcaagatggaaagattcttcgtcaagaaagtttaaatttgatcaagaacgatcaaaacttcaaagccatcaattatcaggagaaattacataaaaaggaaatcgaacgcgatcaggctcgcaagtcttggggatcgattgaaaatattaaggaattgaaggagggctatttgagccaggtggtgcatacgattagcaaattgatggtcgaacacaatgcgatcgtggttcttgaagatctgaactttgggttcaagcgtgggcgtcaaaaggtcgaacgtcaagtgtatcagaaattcgagaagatgcttatcgagaagttaaattttttggtttttaaggataaagagatggacgaaccgggtgggattttgaaggcttatcaattgaccgataacttcgtctcattcgaaaagatgggcaaacagacgggctttgttttttacgtcccggcatggaacacgtcaaagattgatcctaagactgggtttgttaattttttgcatcttaactacgagaatgtgaatcaggcaaaggaattaattggtaagtttgatcagattcgctataatcaggatcgtgattggttcgagttccaggttactacggaccagtttttcaccaaggagaatgcgcctgacacacgtacctggatcatctgctctacccccaccaaacgtttctacagtaaacgtactgtcaatggaagcgtctctaccattgaaatcgacgttaatcaaaaattgaaagagttgtttaatgattgtaactatcaagatggggaagatttagttgatcgcatccttgaaaaggattcgaaggatttcttttcaaagttaattgcctatctgcgcatcttgacttcgttacgccaaaacaatggcgaacaaggctttgaagaacgtgattttatcctgtcacctgttgttggtagcgacggtaagtttttcaactcgcttgacgctagttctcaggaacctaaagatgcggacgctaacggagcgtatcatatcgcccttaaaggtctgatgaatctgcacgtcattaatgagactgacgatgaatcattaggaaaacccagttggaagattagtaataaagattggttaaactttgtatggcaacgcccatctcttaaagcgtaa

SEQ ID NO: 114 - DNA, 3816 bp, Artificial Sequence
  Description of Artificial Sequence: Synthetic polynucleotide
atgaagaaccttgctaatttcacgaatctttattcgctgcagaagacgcttcgctttgagttaaagccgatcggtaagaccttggattggatcattaagaaagacttgctgaagcaagacgagattttagccgaagactacaagattgtgaagaagattattgatcgttatcataaagattttattgatctggcgttcgaaagcgcatacttacagaagaaaagctccgatagtttcactgcgattatggaagcaagcattcaatcttactcggagttatactttatcaaagaaaaaagtgaccgtgataagaaggcaatggaagaaattagtgggatcatgcgtaaagagatcgttgaatgcttcacgggaaagtattccgaggtagttaagaagaaatttgggaatttgttcaaaaaagaactgattaaagaagatttattgaatttttgtgaaccggatgaattgccgatcatccaaaagtttgccgacttcactacttatttcacgggatttcacgaaaatcgcgagaatatgtattccaacgaagagaaagcaactgctattgcgaaccgtcttatccgcgaaaatttaccccgttacctggacaatttacgtattatccgcagtattcaggggcgctacaaagatttcggatggaaggacctggagtccaatttaaaacgtatcgacaaaaacttacaatacagtgattttcttaccgagaatggatttgtgtacactttctcccagaaagggatcgaccgttacaacttgatcctgggcggccaatccgtagaaagtggtgagaagatccagggacttaacgaattgattaatctttaccgccaaaagaaccaattagatcgtcgtcagcttcctaatctgaaggagttgtataaacagattctgtccgatcgtacccgccactcttttgtccccgagaaattctcgtctgacaaagcactgttacgtagtcttctggacttccataaagaggtgatccagaataaaaatttattcgaagaaaagcaggtctctcttttgcaagccattcgcgaaaccttgaccgacttaaaatctttcgatttagatcgtatttatttaacgaacgacacgtcgttgacacagatctcgaacttcgtatttggcgattggtccaaggtgaaaaccatccttgccatctattttgatgaaaatattgccaatcctaaagaccgccaacgccagtcgaatagttatttgaaggccaaagagaactggttaaaaaaaaactattactccatccacgagctgaacgaagctatttcagtatacggaaagcacagtgacgaggagttaccaaatacaaagatcgaagactatttctccggtctgcaaacaaaagatgagactaaaaaaccgattgatgttttagatgcgatcgtctccaagtatgcagatctggaatctcttttgacaaaggaatatccagaagacaaaaatttgaagtctgataagggttcgattgaaaagattaagaattatttagactcgatcaagcttttgcaaaattttcttaaacctttgaagccaaaaaaggtgcaggatgagaaagatcttggcttctacaatgatttagagctgtacctggaatcgctggaatcggcgaatagcttgtataacaaggtccgcaattatcttactggaaaagaatattccgatgaaaaaattaaattaaatttcaaaaatagtactttattagatgggtgggatgagaataaggaaaccagcaacctgtccgtcatttttcgtgacacaaacaattactatctgggaatcctggacaaacagaacaatcgcatctttgagtcaatcccagagatccaatcgggcgaggagactattcaaaagatggtatacaaattattgcccggcgcaaacaatatgctgcccaaggttttcttttcggagaaggggctgctgaaatttaacccgtcggacgaaattacctcattatattcggagggacgtttcaaaaaaggcgataagttctcaattaattccttacacacacttatcgacttctacaaaaaaagtcttgctgttcatgaagactggtcagtatttaacttcaagttcgacgaaacttctcactatgaggacatcagtcagttttaccgccaagtcgaatcacagggctataaaatcacatttaagcccatcagtaagaagtatatcgataccttggtagaagacggcaagttatatttgtttcagatttataataaagacttttcgcaaaacaagaaaggaggaggaaaaccgaatcttcacaccatttattttaaatctcttttcgaaaaggaaaatttaaaggacgtcatcgtaaaacttaatgggcaggcggaagtctttttccgtaagaaatcaattcattatgacgagaatatcacgcgctatgggcatcattccgagcttttgaagggacgcttctcttacccgatcctgaaggacaaacgcttcactgaagacaaatttcaatttcacttccctatcacattgaactttaaatcaggagaaattaagcagtttaatgcacgcgtaaactcttaccttaagcacaataaagatgttaaaatcattggaattgaccgtggagagcgccatttactttaccttagcctgatcgatcaagacgggaagatccttcgccaagagagccttaaccttattaagaatgatcagaatttcaaggccattaattatcaagagaagttacacaagaaggagattgaacgcgaccaagcccgtaagtcctggggtagcattgaaaacattaaggagctgaaggagggatatttgtcgcaagtagtgcatactatctcgaagttaatggtggaacataatgcaatcgtggtcttagaggatcttaatttcggattcaaacgtggtcgtcaaaaggtagaacgtcaagtctaccagaaatttgaaaagatgctgatcgaaaaattaaatttccttgtgttcaaggacaaagaaatggacgagccaggaggaattctgaaggcgtaccagctgactgataatttcgttagcttcgagaagatggggaaacaaacaggattcgtgttttatgtgccggcttggaatacttcaaaaatcgacccgaaaactggtttcgttaattttctgcatttgaattacgagaacgtcaaccaggcaaaggaattaatcggaaagtttgaccaaatccgttacaatcaggaccgtgattggttcgaattccaagtcaccacagatcagttttttacaaaagaaaacgcaccggacacacgcacctggattatctgttcaacccctactaaacgcttctattcgaaacgtaccgtcaatggttccgtgagtactatcgagattgacgtcaaccagaaactgaaagaattgttcaatgattgcaattatcaagatggcgaagacttagtggatcgcattctggaaaaagactctaaggacttctttagtaagttaattgcgtaccttcgtatcttaacctcgttacgccagaacaacggagaacagggcttcgaagaacgtgacttcatcttatctcccgtggtcggctcagacggtaagttttttaattcactggacgcgagctctcaagagcctaaagatgccgacgctaatggagcctatcatattgcgttaaaaggactgatgaacctgcacgtgatcaacgaaaccgacgatgaatccttgggcaagcccagctggaagatcagcaacaaagactggttgaattttgtatggcagcgcccctcattgaaggcgtaa

SEQ ID NO: 115 - DNA, 3738 bp, Ruminococcus sp.
atgcaagagcataaaaaaatatcgcatcttacacacagaaattcagttcaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccaggttagataaattaaaagattatactgatatttactatcactgtaatacggatgcagaccgaaaaagacttgatgaatgtgcatcggaattaaggaaagaaatcgtcaaaaattttaagaatagagatgagtataacaaactattcaataaaaagatgattgagatagttcttcccaaacatcttaaaaatgaggacgaaaaggaagttgtaacctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggcctttgaaaaagcaatttctaaactatccaaaaacgcaattgatgatttagataccacttattccggcttatgtggtacaaatttgtatgacgtttttacagttgattattttaactttttgcttccacaatccggaattaccgaatataacaaaatcatcggcggttacacaacaaacgacggtacaaaagttaagggtattaacgaatatataaatttgtacaatcaacaagtatccaaacgggataaaattcctaatcttaaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataatccctctcttaatggaatttacattcaaaatgaccgatccgtgacaaatctgtcaaacagtatgttcggttcttggtcggtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattctgaaaatgatgaaatcagagaaaagtctatcgtagattactacaagacttctttaatgcaacttaccgacaatttgtcagacaaatacaacgaagcagcacctctgctcaatgagaattactctaatgaaaaaggtttgaaaaatgacgataaatctatttcattaattaaaaattttcttgatgccataaaagaaattgaaaaattcataaagcctttgtccgaaactaatattacaggtgagaaaaatgatttgttttacagtcagttcacaccattacttgataatatcagcagaatagacatattatatgataaggtcagaaactatgttacacaaaaaccgttttcaacagataaaatcaagcttaactttggcaattcacagctattaaacggctgggatcgaaacaaagaaaaagactgcggtgccgtttggctttgtaaagatgaaaaatattatcttgcaatcatagataaaagtaataatagtattttggaaaatattgattttcaagactgcgatgaaagcgattgttatgaaaagataatttacaagcttctccccggtccaaataaaatgcttccaaaagttttcttttcagaaaagtgcaagaaacttttgtcaccgtcagacgaaatacttaaaatttataaaagcggcactttcaaaacaggtgataagttcagccttgatgattgccataagttaattgatttctacaaagaatcattcaaaaagtacccaaattggttaatttataactttaaattcaaaaaaacaaacgaatataacgatatccgcgaattttataatgatgttgctttacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaaggaatcttgaagatgtggtgtacaggcttaacggtgaggcagaaatgttttatcgtcctgcaagtataaaatatgacaaaccaactcatcccaaaaacacaccgataaaaaacaaaaatacactcaatgataaaaaaacaagcacttttccttatgacttaatcaaagataaacgctacactaaatggcagttttcacttcacttccctattaccatgaattttaaagctccggataaggcaatgatcaatgatgatgtcagaaatctgctgaaatcctgcaacaacaatttcatcataggaattgacagaggcgaaagaaacttgctttatgtcagcgtaattgacagcaacggtgctataatatatcagcactcactcaatattatcggaaacaagtttaaagaaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgacgaagaaggcggtttacttcatgcctatcagcttacgaacaagcttgagagctttgataagcttggcatgcaaagcggttttattttctatgttcgtcctgattttacaagcaaaattgatcccgttaccggctttgtaaatttgttgtatcctcaatatgaaaacattgacaaagccaaagatatgatttcaagatttgacgaaataagatacaatgccggcgaggacttttttgaatttgacattgattacgatgagtttccaaagactgcgtctgactatcgcaaaaagtggacaatctgtactaacggcgaaaggattgaagctttcagaaatcccgcaaacaataacgaatggagttaccgtacaataattcttgcggaaaaattcaaagaattatttgataacaattctataaattatcgtgattctgacgatttgaaagctgaaattctttcacagacaaagggcaaattttttgaggatttctttaaattattaagacttaccctacagatgcgaaacagcaaccctgaaacaggcgaggaccgtattctttctcccgtcaaggacaaaaacggtaatttttacgacagttcaaaatatgatgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgaccaatggctgaaatttgttcaggagaatgatatggcgaataattaa

SEQ ID NO: 116 - DNA, 3738 bp, Artificial Sequence
  Description of Artificial Sequence: Synthetic polynucleotide
atgcaggaacataaaaagatttcacatctgacgcaccgcaattcagtacaaaagactattcgtatgcaattaaatcccgtgggtaaaaccatggattactttcaagcaaagcagattttggagaatgatgagaagttaaaggaaaattatcaaaaaatcaaggaaatcgcagatcgcttctaccgtaatctgaatgaagacgtactttctaaaacgcgcctggataaattaaaagactataccgacatttattaccactgcaacacagatgcggaccgtaagcgtctggacgaatgcgcctcagagctgcgcaaggaaatcgtcaaaaactttaaaaaccgcgacgagtataataagcttttcaataagaagatgattgaaatcgttctgccgaaacatttaaagaacgaggatgaaaaagaagtcgtcacgtctttcaaaaattttaccacatatttcaccggattctttacgaatcgtaagaatatgtattcggatggggaagaatcaaccgccattgcctaccgctgcatcaacgagaacttgccaaaacatcttgacaacgtcaaagcgtttgagaaggccatttcaaagctttctaagaacgcaatcgatgacctggatacgacttattcaggtttgtgcggtacgaacctttacgacgtattcactgttgactactttaattttttgttgccacagtccggcatcacagaatacaataaaatcattggcggatatacaacgaacgatggcacaaaagtgaagggaattaacgaatacatcaacctttacaatcaacaggtatcaaagcgcgataagatccctaacttaaagatcttgtacaagcaaattttgtctgaaagcgagaaagtaagtttcattccacccaagtttgaagatgacaacgaattattgagcgctgtctctgagttttatgcaaatgacgaaacgtttgatggcatgccccttaaaaaggctattgacgaaacgaaactgttattcggaaatcttgataatccttctttgaacggcatttatattcagaacgaccgttcagtaaccaatctgtcgaactctatgttcggctcgtggtctgtaatcgaggacctgtggaataagaattatgactcagtcaattcaaatagccgtatcaaggacattcagaaacgtgaggacaagcgtaagaaggcctacaaagccgaaaaaaaactgtcgttgtcttttcttcaagtcttgatttcaaactctgaaaacgatgagatccgtgagaaaagtattgtggactattacaaaacttcgttaatgcagcttactgataacctgagcgataaatacaatgaggccgctccgttactgaacgagaattacagtaacgagaagggacttaaaaacgacgataaatctattagtcttatcaaaaacttcttggatgccattaaggagatcgagaaatttattaaaccacttagcgagacaaatatcactggcgagaaaaatgacttattctactcgcagttcaccccgcttctggataacatcagccgtatcgacattctgtatgataaggtgcgcaattatgtaacgcaaaagccatttagtactgataaaatcaagcttaactttgggaattctcaattgctgaatggatgggatcgtaacaaagagaaggactgtggtgcggtatggttgtgcaaagatgagaaatactacctggcgattatcgataaatccaacaatagcattcttgagaatattgactttcaggactgtgatgaatcggactgctacgaaaagattatctataagctgcttccaggcccaaacaaaatgttgcctaaagtttttttttctgagaagtgcaaaaaattattatcaccctctgatgaaattctgaaaatctacaagagcgggacatttaaaaccggggacaaattcagcctggacgactgccacaaattgatcgacttctacaaggaaagttttaaaaaataccctaactggctgatttacaacttcaagttcaaaaaaactaatgagtataatgacattcgtgagttctacaacgatgtggccctgcaaggttacaatatcagcaaaatgaagatcccaacaagctttatcgacaagttagtggacgaaggcaagatttatttatttcaattatacaataaagacttttcgccgcacagtaaaggaactcccaatcttcatacgttgtacttcaaaatgctttttgatgagcgcaatttagaggatgtagtctatcgcctgaacggtgaggctgagatgttttaccgtcctgcctcaatcaaatacgacaagccaacgcatcccaaaaacacgcccattaaaaataagaatacccttaatgacaaaaagacatccacctttccttacgatctgatcaaagataaacgctacaccaagtggcaattttcgttacatttccctattacgatgaattttaaagcacccgacaaggcaatgatcaacgacgacgtacgtaatcttttaaagagttgtaataacaacttcattatcggaattgaccgtggggaacgtaaccttctgtatgtgagtgtcattgattcgaatggcgcaattatctaccaacactcattgaacattattggcaataagtttaaagaaaagacttatgagacaaactatcgtgagaaattagcgacacgcgagaaggagcgtacggagcaacgccgcaattggaaggctatcgagagtatcaaagaacttaaggagggatacatcagccaagctgttcacgtaatctgccagctggtcgtgaagtacgatgcaatcatcgtcatggaaaagctgacagacggatttaagcgtggtcgcaccaaattcgaaaaacaagtctatcaaaagttcgaaaagatgttaatcgacaaactgaattattacgttgacaaaaaactggatccggacgaggaaggggggttgctgcacgcctaccaactgaccaataaattggaaagtttcgacaagttaggtatgcaatccggcttcattttctatgtacgccctgactttaccagtaagattgatcccgttactggtttcgtgaatcttctgtatccccagtacgaaaacattgacaaagcgaaggatatgattagtcgttttgacgaaattcgctataatgcgggtgaggatttctttgagttcgatatcgattacgatgaatttccgaaaactgcctcggactaccgtaaaaaatggactatctgcacaaatggggagcgtattgaggcgtttcgtaaccctgcgaataacaatgagtggtcataccgtacaatcatcctggcggaaaaatttaaggagttgtttgacaacaactcgatcaactatcgtgactccgacgaccttaaggccgagatcctgtcccagactaaaggcaagttcttcgaggattttttcaaactgcttcgcttaaccctgcagatgcgtaactcgaatcccgagaccggtgaagaccgtatcctttctccagtcaaagataaaaacgggaacttttatgatagttccaaatacgatgaaaaaagtaagcttccatgcgatgccgatgctaacggtgcgtataacatcgcccgcaaagggctttggatcgttgagcagttcaagaaagctgacaatgtgtctacggtagagcccgtaattcataatgatcaatggctgaaatttgtacaagaaaatgatatggcgaataattaa

SEQ ID NO: 117 - DNA, 3738 bp, Artificial Sequence
  Description of Artificial Sequence: Synthetic polynucleotide
atgcaggagcataagaaaatttctcacttgacccatcgtaattcggtccaaaaaacaattcgcatgcaattgaaccctgtcggtaagacgatggactattttcaggccaaacagatcttggaaaatgacgagaagttgaaagaaaactaccaaaagattaaagagattgcagatcgtttctatcgtaatttaaacgaagatgtgttatccaaaacgcgtctggataaactgaaagactacacagatatttattaccattgtaatacggatgctgatcgtaaacgcttagatgagtgcgcatcggaactgcgcaaagaaattgtaaaaaatttcaaaaaccgtgacgagtataacaagcttttcaataagaagatgattgagattgtattgccgaagcacctgaagaatgaagatgaaaaagaagtagtcacaagtttcaagaatttcacgacctacttcactggcttcttcaccaaccgtaagaatatgtactcagatggtgaagaatccacggcgattgcttaccgttgcatcaacgaaaatcttccaaaacacttagacaacgtaaaagcatttgaaaaagccattagtaagttatcgaaaaacgcaatcgatgatttggacaccacgtattcggggttgtgcgggaccaatctttatgatgtatttacagttgattacttcaactttctgctgccgcagagcggtattacagaatataataaaattatcggaggttatacgacaaacgatgggaccaaagtaaaagggatcaacgagtatatcaacctttataaccagcaagtctcgaagcgcgataaaattccgaatcttaaaatcttgtataaacagattctgagcgagtcggagaaagtttcatttattccgcccaagtttgaagatgacaatgagcttctttcagcagtgtctgagttctacgccaacgacgagacgttcgatggcatgcctctgaagaaagctattgatgaaacgaagttacttttcgggaatttagataaccccagtttgaatggaatttacattcagaatgatcgctctgttacgaatttaagtaatagtatgtttggttcctggtccgtcatcgaggatctgtggaacaaaaactacgactccgtcaactcaaatagtcgtatcaaggatattcaaaagcgcgaagataagcgcaaaaaagcatataaggctgaaaaaaaattatccttatcgtttttgcaagtcctgatcagcaactctgagaatgatgagatccgcgagaagagcatcgttgattactataaaacttccttaatgcaattaaccgataatctttccgacaaatacaatgaggcagcgccattattgaatgagaactacagtaacgaaaaggggctgaaaaacgacgacaaatcgatcagtttaatcaagaatttcttggatgcaatcaaagaaatcgagaaatttatcaagccgctgagtgagaccaatattacaggggagaagaacgacttgttctattctcagttcactcctctgcttgacaatatctcgcgtattgatattctttacgataaagtgcgtaattatgtaacacaaaaaccgttttcgacagataaaatcaaacttaattttggcaattcgcagcttttaaatggctgggaccgcaataaagagaaggattgcggcgcggtatggttgtgcaaggatgagaagtactatttagctattattgacaaatcgaataatagtatcttagagaatattgacttccaagattgtgatgagtcggactgttatgagaagatcatctataagcttttgcctgggccgaacaagatgttacctaaagtttttttcagcgagaagtgcaaaaagttgctttcacccagtgatgagatcttaaaaatttataaatcaggtacattcaagactggtgataaattcagtttagacgactgccataagttaatcgacttttacaaagaaagttttaagaagtacccgaactggctgatttacaactttaaattcaaaaaaactaacgaatacaacgacatccgtgagttctacaatgacgtagcattacaagggtacaatatctcaaaaatgaagattcccacaagcttcatcgataaattagtagacgagggaaaaatttacctttttcaattatataataaagatttctcaccgcattcaaaaggcacacccaacctgcacacattgtacttcaaaatgctgttcgacgaacgcaatctggaagacgttgtctaccgcttgaatggggaagcagagatgttctatcgtccagcgtcaattaaatatgataaacccacacatccaaaaaacactcctattaaaaacaaaaatacgcttaatgataaaaaaactagcaccttcccgtacgacttaattaaggacaagcgttacacaaagtggcagttttcgttgcactttccgatcaccatgaactttaaagcaccagacaaagcaatgatcaacgatgacgttcgtaacttgttgaaaagttgcaataacaatttcattattggtatcgatcgcggggagcgtaatctgctgtatgtatccgtcatcgactcaaatggcgccatcatctatcaacactcattgaatattatcggtaacaagttcaaggagaaaacttacgaaaccaattaccgcgagaagttagctactcgcgaaaaagaacgtaccgagcaacgccgcaactggaaggccattgagagcattaaagaactgaaagagggctacatttcacaggcggtacacgtgatctgccagcttgttgtcaagtacgacgccatcattgttatggaaaaattaactgacggttttaagcgcggccgcaccaagtttgagaagcaggtttaccagaaattcgaaaagatgttaatcgataaacttaactactacgtagacaaaaagttggatccagacgaagagggcggactgcttcatgcgtatcaattaacgaataagttggagtcctttgataagcttggaatgcaaagtggtttcatcttctatgtccgtccggattttaccagcaaaattgacccggttaccgggtttgttaatctgttatatccccagtatgagaatatcgataaggcgaaggatatgatttcccgctttgatgagatccgttacaatgccggagaggacttcttcgagtttgacatcgattatgatgaattccctaaaactgctagtgattatcgcaaaaagtggactatctgcaccaatggggaacgtattgaggcttttcgtaaccccgctaacaacaatgaatggagctaccgtaccatcatcttagctgaaaaattcaaggaactgttcgataacaactcgattaactatcgtgattccgacgatttgaaagctgagattctttctcagacaaaagggaagtttttcgaagatttctttaagttgctgcgccttacattacagatgcgcaatagcaaccctgaaaccggagaggatcgcattcttagtccagtgaaggataaaaacggcaacttttatgattcgagcaaatatgatgagaaatccaagttgccatgtgacgcagatgctaacggtgcttataacatcgctcgcaaaggcttatggattgtagagcaatttaaaaaagcggacaacgtttcgacagttgaaccggtgattcacaatgaccagtggcttaaattcgtgcaggaaaatgatatggcaaacaattaa

SEQ ID NO: 118 - DNA, 3738 bp, Artificial Sequence
  Description of Artificial Sequence: Synthetic polynucleotide
atgcaggaacataaaaaaatcagtcacctgacacatcgtaactccgttcagaaaactattcgtatgcaattgaatcccgtaggtaagaccatggattactttcaggccaagcaaattttagaaaacgatgaaaagttaaaagaaaattatcagaaaatcaaagagattgctgaccgtttctaccgcaatttaaacgaggatgttctgtcaaagactcgtttagacaaacttaaagactatacagacatctattaccactgcaatacggacgcagaccgtaagcgtctggacgagtgcgcgagcgagcttcgcaaggagattgttaaaaattttaagaaccgtgacgaatataataagttgtttaataaaaaaatgattgagattgtccttcccaagcacttaaagaacgaggacgagaaggaagtagtaacatcatttaaaaatttcacgacttactttactgggttcttcactaaccgcaagaatatgtattctgatggggaggagtctactgctatcgcatatcgctgtattaacgagaatctgccaaaacatcttgacaacgtcaaagcatttgaaaaagctatctcgaagctgtccaaaaatgctattgacgacctggacactacgtactcaggtttgtgtgggacgaacctttacgacgtctttacggtggactactttaatttcttactgccgcagtcagggattacggaatacaataaaattattggaggctacacgacaaacgatggaacaaaagtgaagggaattaatgaatatatcaatctgtataatcagcaggttagtaagcgtgataaaattccaaaccttaagatcctttataaacaaattttgtcggagagcgagaaagtaagttttattcccccgaaatttgaagacgataacgaattattatctgcagtttcagagttctacgctaacgacgagacgttcgacggtatgccgttaaaaaaggccatcgacgaaactaagcttttgtttggtaacctggataatcccagtctgaatggtatctacatccagaatgatcgtagtgtcacaaatttaagtaacagtatgttcggaagctggtctgtaattgaggacttgtggaacaagaattacgactcggtgaattccaattctcgcatcaaggatattcaaaaacgcgaagataaacgtaagaaggcgtataaggctgagaagaaactttctttaagtttcctgcaggtgttgatttctaactcggaaaacgacgagatccgtgaaaagtcgattgtcgattactacaagaccagtttgatgcaattaacggataatttgtcagacaaatacaatgaggcagcaccattgcttaacgaaaactattcaaatgagaagggattgaaaaacgacgacaagtccatctcacttatcaaaaacttcctggacgccatcaaagagattgaaaaatttatcaagccattaagcgaaacaaatatcacaggcgaaaaaaacgacctgttctattcgcaattcacaccgctgctggataacatctcacgtatcgatatcctgtatgataaagttcgcaattatgtgacgcagaagccctttagcaccgataagatcaaattaaacttcggaaactcgcaattactgaacggatgggaccgcaacaaagagaaggattgtggtgcagtctggctttgcaaagatgagaagtattaccttgctatcatcgataagtctaacaatagtatcttggagaacatcgattttcaggattgcgacgaatctgactgttatgagaaaatcatctataaacttcttccgggccccaataagatgctgccgaaggtattcttctctgaaaaatgtaaaaagttactgtcacccagcgacgaaatcttgaagatttataaaagtggaacatttaagactggtgataaattttcactggacgactgtcacaaacttattgacttttacaaggaatcatttaagaagtatccaaactggcttatctataacttcaaattcaaaaagacaaacgagtataatgatattcgcgagttttacaacgacgtcgcacttcaagggtacaatatcagcaagatgaaaattccgacatcatttattgataagcttgtcgacgaaggtaagatctacctgtttcagttgtacaacaaagattttagcccacactctaagggaactccgaatttacacacgctttactttaagatgcttttcgacgagcgcaaccttgaggacgtggtttatcgtttaaacggtgaggctgaaatgttctatcgcccggcttctattaaatatgataaaccgacacatccgaaaaacactcccattaaaaataaaaatacgcttaatgataagaagacatccacattcccatacgaccttatcaaagacaagcgctatacaaaatggcagttttcccttcattttcccattaccatgaacttcaaagcgccggataaggcaatgattaacgacgacgtgcgtaatttattgaaatcatgtaataataactttattatcgggatcgaccgtggtgagcgtaatctgttgtatgtaagtgtaatcgactcgaacggggcaatcatttatcaacatagcttgaacatcatcgggaataaatttaaggaaaaaacgtatgaaacaaattatcgcgagaagttggcaacccgtgagaaagagcgcacagagcagcgccgcaactggaaagctattgagtctatcaaagaattgaaagagggctacatctcacaagcggtccacgttatctgccaactggttgtgaagtacgatgctatcatcgtcatggaaaagctgacggatgggtttaaacgcggtcgtaccaagttcgagaagcaagtctaccaaaaatttgaaaaaatgttgattgacaaacttaattattatgtagataagaagttggatcccgatgaagagggtggtctgttacacgcttatcaattaaccaataagttagaatcgttcgacaagcttggtatgcaaagtgggttcatcttctacgttcgccccgacttcacgtccaagattgatcctgtcactgggtttgtaaacttactttatccacaatacgaaaacattgataaagctaaagacatgattagtcgttttgatgaaatccgttacaatgctggtgaagatttcttcgagttcgatatcgactacgatgagtttcccaagacagccagtgactaccgcaaaaagtggaccatctgtacgaacggcgagcgtatcgaagcatttcgcaaccctgcgaataacaatgaatggagctatcgcacgatcatccttgctgagaaatttaaagaattgtttgacaacaactcaatcaactaccgtgattcagatgacctgaaggcggaaattctgtctcagacaaaagggaagtttttcgaggatttttttaagcttcttcgcctgacactgcagatgcgtaatagcaacccggagacaggggaagaccgtattctgtctcctgttaaggataaaaatggcaacttttacgacagttcaaagtacgatgaaaaaagcaagcttccatgtgatgctgatgcaaatggagcctacaacatcgcccgtaaaggattgtggattgttgagcagttcaaaaaggcggacaatgtatcgacagtagagcccgtaatccacaacgatcagtggttgaagtttgtccaagaaaacgacatggcaaacaattaa

SEQ ID NO: 119 - DNA, 3738 bp, Ruminococcus bromii
atgcaagagcataaaaaaatatcgcatcttacacacagaaattcagttcaaaaaacaattaggatgcaactgaatcctgtaggtaaaacaatggattattttcaagcaaagcaaattcttgagaatgatgaaaagcttaaagaggactatcagaaaatcaaggaaatagcagacaggttttacagaaatttgaatgaggatgtactttcaaaaaccgggttagataaattaaaagattatgctgatatttactatcactgtaatacggatgcagaccgaaaaagacttaatgaatgtgcatcggaattaaggaaagaaatcgtcaaaaattttaagaatagagatgagtataacaaactattcaataaaaagatgattgagatagttcttcccaaacatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttgcctaagcatcttgacaatgtcaaggtctttgaaaaagcaatttctaaactatccaaaaatgcaattgatgatttaggtgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttaaaattttgtataaacaaattttaagtgagagtgaaaaggtatcattcataccgcctaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaatgatgaaatcagagaaaagtctatcgtagattactacaagacttctttaatgcaacttaccgacaatttatcagacaaatacaaagaagcagcacctctgttcagtgaaaattacgataatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggtaattcacagctattaaacggctgggataaagacaaagaaagagagtacggagccgttttgctttgtaaagatgaaaagtattatcttgcaatcatagataaaagtaataatagtattttggaaaatattgattttcaagactgcaatgaaagcgattattatgaaaagatagtttataaacttctgactaaaataaatggaaatctcccgcgtgttttcttttcagaaaagcgcaagaaacttttgtcaccatcagacgaaatacttaaaatttataaaagcggcactttcaaaaaaggtgataagttcagccttgatgattgccataagttaattgatttctacaaagaatcattcaaaaagtacccaaattggttaatttataactttaaatttaaaaacacaaacgaatataatgatatcagcgaattttataatgatgttgcttcacagggatataatatttcaaaaatgaaaatcccgacaacatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcagaaatgttttatcgtcctgcaagtataaaatatgacaaaccaactcatcccaaaaacacaccgataaaaaataaaaatacactcaatgataaaaaagcaagcacttttccttatgacttaattaaagataaacgctacactaaatggcagttttcacttcacttccctattaccatgaattttaaagctccggataaggcaatgatcaatgatgatgtcagaaatctactgaaatcctgcaacaacaatttcatcataggaattgacagaggcgaaagaaacttgctttatgtcagcgtaattgacagcaacggtgctataatatatcagcactcactcaatattatcggaaacaagtttaaaggaaaaacatacgaaactaactaccgggaaaaacttgcaacaagagaaaaagatcgtacggaacagcgccgtaactggaaagcaattgagagtataaaagaactcaaagagggatatatcagtcaggctgtgcatgttatatgtcagcttgttgtcaagtacgatgcaatcatcgttatggaaaagctgactgacggattcaaacgaggtagaacaaagtttgaaaaacaggtttatcagaaatttgaaaaaatgctgattgacaaacttaattactatgttgacaaaaagcttgatcccgacgaagaaggcggtttacttcatgcctaccagcttacgaacaagcttgagagctttgataagcttggtacgcaaagcggttttattttctatgttcgtcctgattttacaagcaaaattgatcccgttaccggctttgtaaatttgttgtatcctcgatatgaaaacattgacaaagccaaagatatgatttcaagatttgacgatataagatacaatgccggcgaggacttttttgaatttgacattgattacgataagtttccaaagactgcgtctgactatcgcaaaaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttcttcaaattattaagacttaccctacagatgcgaaacagtaaccctgaaacaggcgaggaccgtatcctttcccccgtcaaggacaaaaacggcaatttttacgacagttcaaaatatgacgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgacaaatggctgaaatttgttcaggagaatgatatggcgaataattaa

SEQ ID NO: 120 - DNA, 3738 bp, Artificial Sequence
  Description of Artificial Sequence: Synthetic polynucleotide
atgcaagagcataagaaaatttcccacttaacccatcgtaattccgttcaaaagactattcgcatgcaacttaaccctgtgggtaagacaatggactacttccaggctaaacaaattcttgaaaatgacgaaaagttaaaagaagactatcagaaaattaaagaaatcgctgaccgtttttaccgtaaccttaatgaagacgtattaagcaagaccggtttggataaactgaaggactatgccgacatctactatcactgtaacactgacgctgaccgtaagcgtttgaatgagtgcgcttcagaacttcgtaaagaaatcgtcaaaaatttcaaaaatcgtgacgaatataacaaactttttaataaaaagatgattgaaatcgtcttgcccaaacacctgaagaatgaggacgagaaagaagtagtagcttccttcaaaaactttacaacgtattttaccggtttctttaccaatcgtaaaaacatgtactccgacggagaggaatccacggccatcgcctaccgctgtattaatgaaaacttacctaagcatcttgacaacgtcaaagtattcgagaaggcgatctccaaactgtcgaaaaacgctattgatgatttaggcgcgacctacagcggtttatgtgggacaaacttgtatgacgtgtttacagtggactattttaactttttgcttccgcaatcggggattacggaatacaataagattatcggtggatatactacatcggacgggacgaaagttaagggtatcaatgagtacattaatctttacaatcagcaagtatccaaacgtgacaagatccctaacttaaagatcttatacaaacaaatcttgtcagaatcggaaaaagtttcattcattcctcccaaatttgaggacgacaatgaacttctttcagcagttagcgagttctatgccaacgatgagacatttgacggtatgcctttgaagaaagcgatcgacgaaacgaagttacttttcgggaatttagataattcgtccttgaacggaatttacattcaaaacgaccgcagcgtgaccaatctgtcgaactctatgttcggctcatggagcgtcattgaagatctgtggaataaaaattatgattcggtaaacagcaactcgcgcattaaagacattcaaaaacgtgaggacaaacgtaagaaggcgtataaggctgagaagaaactgtcgttatcttttttgcaggtactgattagtaattcagagaacgatgaaattcgtgaaaagtcgatcgttgattattacaaaacatcattaatgcagctgaccgataatctttccgataaatacaaggaggcagcgccgctgtttagcgaaaattacgacaacgagaagggcttaaaaaacgacgataagtctatttcattaatcaagaattttttagacgctatcaaggaaatcgaaaaattcattaagcctctttctgagacaaacatcactggagagaagaacgacttgttctacagtcaatttacccctttgttagataatattagccgtatcgatattttatacgataaggtacgcaattatgttacgcaaaagcctttctcaacggataaaatcaagctgaactttggtaatagtcagcttttaaacggctgggataaggataaggaacgcgagtatggggccgtgttgttatgtaaggacgagaaatattatttggccatcattgacaaatccaacaattccattctggaaaatatcgactttcaagattgtaacgagtctgactattatgagaagatcgtatataaactgttgacgaagatcaacggtaacttaccccgcgtatttttttcagaaaaacgcaaaaaacttctgagccccagtgatgaaattctgaagatttacaagtctgggacttttaagaagggcgataagttctcattagacgattgccacaaacttatcgacttttataaagagagttttaagaagtatccgaactggttaatttacaacttcaagtttaaaaacacaaacgagtacaatgacatctcggaattctataatgatgttgcctctcaggggtataacattagcaagatgaaaatccccacaacatttatcgataaattggttgatgaagggaaaatctacttattccagttatacaacaaggatttttctccgcattccaaggggacccctaatttgcacaccttatattttaagatgttgttcgacgaacgcaatcttgaggacgtggtttacaaattgaacggagaagccgaaatgttttaccgtccggctagcattaagtacgataagcctactcatccaaagaacaccccaattaaaaacaagaatacattgaacgataagaaggcgagtacttttccgtacgatcttattaaagataagcgctacaccaaatggcagttctcactgcatttccctattaccatgaactttaaagctcctgataaggctatgatcaacgatgacgttcgcaatttattgaaaagctgcaataataattttattattggtatcgaccgcggtgagcgtaacttgctgtatgtgtctgtgatcgactcaaatggtgctatcatctaccaacactctctgaatatcatcggaaataaattcaagggtaagacgtatgaaaccaactaccgtgaaaagttggctacccgtgaaaaggaccgcacggagcaacgccgtaattggaaagcaatcgaaagtattaaggagttgaaagaaggatatatcagtcaagcggtccatgtgatttgtcaactggtagtgaagtacgacgccatcatcgtcatggaaaagcttaccgatggtttcaaacgtggacgcaccaagtttgagaagcaagtctaccagaagtttgagaagatgttgattgataagctgaactattatgtagacaagaagcttgatccagatgaagaaggcgggcttttacacgcgtatcaactgaccaacaagttggagagcttcgacaaattgggaactcagtccggcttcattttctatgtccgccccgattttacctctaagatcgatccagtaactggctttgtgaatttactgtatccacgctatgaaaatatcgataaggctaaggacatgatttcccgcttcgatgatattcgttacaacgcgggggaggacttctttgaattcgatattgattatgataagtttccaaaaacagcatcggattatcgcaaaaagtggaccatttgtacaaacggagaacgtattgaagcctttcgtaacccggcgaacaataacgaatggagttatcgtacaattatcttggcggaaaagttcaaagaattatttgataacaactcaattaattatcgcgattcggatgaccttaaagcagagattttaagccaaacaaaagggaagttcttcgaagatttcttcaagctgcttcgccttaccttgcaaatgcgtaactcaaatccagagaccggagaggaccgcattttgtcaccagtgaaagataaaaatggaaacttttacgattcgagcaagtacgatgaaaagagtaagttaccttgtgatgcggatgcaaatggtgcatataacattgctcgcaaagggttgtggatcgtggaacaattcaaaaaagcagataatgtaagcaccgtagaaccggtgattcacaacgataagtggcttaagtttgtacaggaaaatgacatggctaataattaa

SEQ ID NO: 121 - DNA, 3738 bp, Artificial Sequence
  Description of Artificial Sequence: Synthetic polynucleotide
atgcaagagcataagaaaatcagccacttaacacatcgcaacagcgtccaaaagacgattcgcatgcaattaaatcctgtgggcaagactatggactattttcaggccaagcagatcttagagaacgacgagaaactgaaagaagattaccagaaaattaaggaaatcgcggaccgtttttatcgtaacctgaacgaagacgtactttctaagactggtctggataagttaaaggactatgcggacatctattatcactgcaatacagatgcggatcgcaaacgcttgaacgaatgtgcgtcggaattacgtaaggagattgttaaaaatttcaaaaatcgcgatgaatataataagttgttcaacaagaaaatgatcgaaatcgtattgccaaagcatcttaaaaatgaggacgaaaaagaggtggtcgcctccttcaagaactttaccacgtacttcacaggcttctttaccaatcgcaagaacatgtatagcgacggcgaggaatcgactgccattgcttaccgttgtatcaacgagaaccttccaaagcatcttgataacgtaaaagttttcgagaaagccatcagtaaattatcgaagaatgcgatcgatgacctgggggcgacctattccggactgtgtgggactaatctgtatgatgtcttcacagtggactactttaattttttattgcctcagagcggtatcactgaatataataaaattatcgggggttacacaacgtcggacgggacaaaagtaaaagggattaatgaatatattaacctttacaatcaacaagtaagtaaacgcgataagattcccaacctgaagatcctgtacaagcagattttgagtgaatcggaaaaagttagtttcattccaccgaaattcgaagacgataatgagctgctttcagcggtatccgagttctacgcgaacgatgagacatttgatggcatgccgcttaaaaaggccatcgacgagactaaattattgttcggaaaccttgataatagctcactgaacggtatctacattcaaaatgaccgctccgtcaccaacctgtccaattcaatgttcggtagctggtcagttatcgaagacttatggaataagaactacgattctgttaattctaatagccgcatcaaagatatccagaagcgtgaagataagcgcaaaaaagcttataaggcggagaaaaagttatcattaagctttttgcaagttttgatcagtaactccgaaaacgacgaaatccgtgaaaaatcgattgtggactactataaaactagtttaatgcaactgactgataacctgtcagacaagtataaagaggcggctcctcttttctcggagaactatgacaatgaaaaaggcttgaagaacgatgacaaatcaatctctttgatcaagaattttctggacgcaatcaaggagattgagaagttcatcaaacccctgtcagagactaatattacaggagagaagaatgacttattttattcgcaatttactccattgctggacaacatctcgcgtattgacattttgtacgataaagttcgcaattatgtaacacaaaagcctttttccacggataaaatcaagcttaactttgggaactctcaattgcttaacggttgggacaaggataaggaacgcgagtacggtgccgtccttttgtgcaaggatgaaaaatactatctggccattattgataagtccaataactcgattttagaaaacatcgacttccaagattgcaatgaaagcgattactatgaaaaaatcgtctataaattattaactaaaatcaatggaaatctgccgcgcgtgttttttagtgaaaaacgcaaaaaacttctttcaccgagcgacgagattttaaagatctacaagtccgggaccttcaaaaagggcgataagttcagtttggacgattgtcacaagctgatcgatttctataaggagtcatttaagaaatatccgaattggttgatttataacttcaagttcaagaacacaaacgagtacaatgatatctcggaattttacaacgacgtggcatcgcagggttataatattagcaagatgaaaatccccaccacgtttattgataagctggtggatgagggcaagatttatcttttccaactttataacaaagacttctcacctcactctaaagggactcctaatttgcatacgctttattttaagatgttgtttgatgaacgcaaccttgaggatgtggtatacaaacttaatggagaagctgagatgttttaccgcccagcctcaattaagtatgacaagccaacccacccaaaaaacactccgattaaaaacaagaatactcttaacgacaagaaggcaagtacctttccctacgacttgatcaaggataagcgctatactaaatggcagttttcattacacttccccattaccatgaattttaaggctcctgataaagccatgattaatgacgacgttcgtaatttacttaaatcttgtaataacaactttatcattggtatcgaccgcggtgagcgtaacttattatacgtctccgtgatcgacagcaatggtgccattatttatcagcactccttaaacatcatcggcaataagttcaaaggaaaaacctatgaaacgaactatcgcgagaaactggcaactcgcgaaaaggaccgcaccgagcaacgtcgcaactggaaagcaattgaatccatcaaagagttaaaggagggatatatctcccaggctgtccacgtaatctgtcagcttgtcgtaaaatacgatgctattatcgtaatggaaaaactgaccgacggatttaagcgcggacgcaccaagtttgaaaagcaagtgtaccaaaagtttgaaaaaatgctgatcgataagttaaactattacgtagacaagaagttggacccggacgaggaaggagggttgttacacgcctatcaactgaccaacaagttggaatctttcgacaaattgggcacacaaagcggtttcatcttctacgttcgcccagatttcacctccaagatcgacccagtaacgggattcgtaaatctgctgtatccgcgttatgaaaatatcgataaggcaaaagatatgatctcacgtttcgacgatatccgttataatgctggggaagacttctttgagtttgacatcgactatgacaaatttccaaaaaccgcttccgattaccgcaagaaatggacaatttgcacgaacggtgaacgcattgaagcatttcgtaatcctgccaacaataacgagtggagctaccgtaccatcatcttagctgaaaaattcaaggagttattcgacaacaactcgattaattatcgtgactccgatgacttgaaggcggagattttgtcgcaaaccaaaggtaagttcttcgaagactttttcaagctgttgcgtttgaccttacagatgcgcaattcgaatccggaaacaggagaagaccgtatcctttctccagttaaagacaaaaatggcaacttttacgactcgagcaaatacgacgaaaaaagcaagctgccgtgtgacgccgatgcaaacggggcgtataacatcgcccgtaaaggtctgtggattgtcgagcagttcaagaaggccgacaatgtctctactgttgaaccagtcatccacaatgataaatggttaaaatttgtccaagagaacgacatggctaacaattaa

SEQ ID NO: 122 - DNA, 3738 bp, Artificial Sequence
  Description of Artificial Sequence: Synthetic polynucleotide
atgcaggaacacaagaagatcagtcatctgacccaccgcaattcagtccaaaagaccattcgtatgcaacttaatccggtgggcaagacgatggactactttcaggcaaaacagattttggaaaatgacgagaaattaaaagaagattatcaaaaaatcaaggaaatcgcagatcgtttttatcgtaatctgaatgaagatgttttgtccaaaacaggattagacaaattaaaagactatgcggacatctactaccactgcaacaccgacgctgaccgcaagcgcttgaatgagtgtgcgtcggagttacgcaaggagatcgttaagaattttaagaatcgcgatgagtacaacaagctgtttaacaaaaaaatgatcgaaatcgtgttaccgaagcacttaaaaaacgaggacgagaaggaagtagtggcgtcatttaagaacttcactacttactttacgggcttttttaccaaccgcaaaaatatgtactccgacggggaagagtccacagcgattgcttaccgctgtattaatgagaatctgcctaaacacttagataacgttaaagtgtttgaaaaggccatctctaagctgtctaaaaacgccatcgacgacttaggtgccacatatagcggtttgtgcggtacgaatctttatgatgtctttactgtagattacttcaattttttattaccgcagtcgggtatcacagagtacaacaaaatcattggcgggtatacaacgagcgatgggactaaggtcaagggcatcaatgaatatatcaatctgtacaatcaacaggttagcaaacgtgataaaattccgaatcttaagatcttatacaaacagattttaagtgaatcagaaaaagtgagctttatcccacctaagttcgaagatgacaacgaattgttgagtgcagtttcagagttttacgctaatgatgaaacgttcgatggcatgcccctgaagaaagccattgatgagacaaaactgttattcggaaacctggacaactcttccctgaatggaatctatattcagaacgaccgctctgtcaccaatctttcgaactcgatgtttggttcttggtcagttattgaggatctttggaacaaaaactatgattccgttaactccaacagccgtattaaggacattcagaaacgtgaagacaagcgcaaaaaggcctataaagccgagaaaaagttatctttgtcgtttcttcaggtacttatttcaaactcagaaaatgatgagattcgcgagaaatctattgtagattattacaaaactagcttgatgcaactgacggataacttaagcgacaaatacaaagaagcggcgcccttattctcggagaactacgataatgagaaggggctgaaaaacgacgataagagtatttcgttaatcaaaaactttcttgatgctattaaggagatcgaaaaatttatcaaaccattatcagaaacgaatatcaccggtgagaaaaacgacttattctattctcaatttaccccgctgttagataatatttcgcgtattgacattctttatgacaaagtgcgtaactacgtgactcaaaagccgttctctacagataaaattaaattgaattttggcaacagccagttgctgaatgggtgggacaaggataaggagcgcgagtatggggcagttttattatgcaaagatgagaaatattaccttgcaattattgacaagtctaacaattcaatcttggagaacattgatttccaggattgtaacgaaagtgactactatgagaaaatcgtatacaagttacttactaagattaacgggaatttgcctcgtgtttttttctcagaaaagcgcaagaagttattatcacccagcgacgagatccttaagatttacaagtccggcaccttcaaaaaaggcgataaatttagcttagatgactgtcacaagctgatcgacttctataaagagtccttcaagaagtatcccaattggcttatctataattttaaattcaagaatactaacgaatataacgacatctctgaattttacaatgacgtagcaagccagggatataacatctcgaaaatgaaaatcccaacaacgtttattgacaagttagtggatgagggcaagatttatcttttccaactgtataataaggacttttccccccattctaaaggtactccaaaccttcatactttatacttcaaaatgttgttcgatgaacgcaatttagaagacgttgtctataagttgaatggtgaggccgagatgttttatcgtccagcgtccatcaagtatgacaagccgacacatcctaagaacaccccaatcaagaataagaacaccttaaatgataagaaagcatctaccttcccctatgatcttattaaagataagcgttatacgaaatggcagttttctctgcacttcccaatcacgatgaactttaaggccccagataaggctatgattaacgatgatgtacgcaatctgttgaaatcctgtaataataattttatcatcggtatcgatcgcggggaacgtaatttattgtatgtctcggtcattgattcgaacggggcgatcatctaccagcacagtttgaacatcatcgggaacaagtttaagggcaaaacttatgagacgaactaccgcgaaaaacttgcgacgcgtgaaaaggatcgtacagagcaacgtcgcaactggaaagctatcgagtccatcaaggaactgaaagaggggtacatcagtcaagcagttcacgtaatttgtcagctggtggtaaagtacgacgcgatcattgtgatggagaaactgacggatggtttcaaacgcggacgtactaaatttgaaaagcaggtgtaccagaaattcgagaagatgcttatcgataaacttaactactacgtagacaaaaagttagatccagacgaagaaggaggtttgcttcacgcctatcaattaactaataagttagagagtttcgataaattggggacgcagtcgggatttattttctatgtacgtccggactttacgagcaaaattgatccggtgaccggctttgtgaacctgttatacccgcgttatgaaaacattgacaaggccaaggatatgattagtcgcttcgatgatatccgctataacgcaggggaagacttctttgaatttgatattgactatgataaattcccgaaaactgccagtgactatcgtaagaagtggaccatttgtacgaatggtgaacgtatcgaagctttccgtaatccagcgaacaacaatgaatggtcttaccgcactatcatccttgccgaaaaattcaaggaattattcgataacaactcaatcaattatcgcgattccgacgaccttaaggctgaaatcttgagccagacgaaaggaaagttctttgaagacttctttaagttgttacgtttgacccttcagatgcgtaactcaaaccccgaaaccggcgaggatcgtatcttaagcccggtgaaagacaagaatggaaacttctacgactcgtcaaaatacgatgagaaaagtaaactgccctgtgatgctgacgcaaacggagcctacaacattgcccgcaagggattgtggattgttgagcaattcaaaaaagctgacaacgtcagtacggttgaacccgttattcataatgataaatggttgaaattcgtacaggaaaacgatatggcgaacaactaa

SEQ ID NO: 123 - DNA, 3738 bp, Ruminococcus bromii
atgcaagagcgtaaaaaaatatcgcatcttacacacagaaattcagttaaaaaaacaattaggatgcaactgaatcctgtaggtaaaacaatggattattttcaagcaaagcaaattcttgaaaatgatgaaaagcttaaagagaactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttaataaatgtgcatcggaattaaggaaagaaatcgtcaaaaattttaagaatagagatgagtataacaaactattcgataaaaggatgattgagatagttcttcccaagcatcttaaaaatgaggacgaaaaggaagttgtagcctcatttaaaaatttcacaacatactttacaggtttcttcactaacagaaaaaatatgtattcggacggagaagaatccacggcaatcgcatatagatgcattaacgaaaatttacctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaaacgacggtacaaaagttaagggtattaacgaatatataaatttgtacaatcaacaagtatccaaacgggataaaattcctaatcttcaaattttgtataaacaaattttaagtgagagtgaaaaggtatcattcataccgccaaagtttgaagatgacaacgaacttttatcggctgtttcagagttttacgcaaacgacgaaacctttgacgggatgccattaaaaaaagcaattgatgaaacaaagctattattcggcaatttagataattcctctcttaatggaatttacattcaaaatgaccgatccgtgacaaatctgtcaaacagcatgttcggttcttggtcggtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttctaattccgaaaatgatgaaatcagaaaaaagtctatcgtagattactacaagacttctttaatgcaacttaccgacaatttatcagacaaatacaacgaagcagcacctctgctcaatgagaattactctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaaacttaactttggcaattaccagctattaaacggctgggataaagacaaagaaagagagtacggagccgttttgctttgtaaagatgaaaagtattatcttgcaatcatagataaaagcaataatcgtattttggaaaatattgattttcaagactgcgatgaaagcgattgttacgaaaagataatttacaagcttctccccactccaaataaaatgcttccaaaagttttctttgcaaaaaagcacaaaaaacttttgtcaccgtcagacgaaatacttaaaatttataaaaacggcactttcaaaaaaggtgataagttcagccttgatgattgccataagttaattgatttctacaaagaatcattcaaaaagtacccaaaatggttaatttataactttaaattcaaaaaaacaaacggatataatgatatccgcgaattttataatgatgttgctttacagggatataatatttcaaaaatgaaaatccctacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtataggcttaacggtgaggcagaaatgttttatcgtcctgcaagtataaaatatgacaaaccaactcatcccaaaaacacaccgataaaaaataaaaatacactcaatgataaaagagcaagcacttttccttatgacttaattaaagataaacgctacactaaatggcagttttcacttcacttccctattaccatgaattttaaagatccggataaggcaatgatcaatgatgatgtcagaaatctgctgaaatcctgcaacaacaatttcatcataggaattgacagaggcgaaagaaacttgctttatgtcagcgtaattaacagcaacggtgctataatatatcagcactcactcaatattatcggaaacaagtttaaaggaaaaacatacgaaactaactaccgggaaaaacttgcaacaagagaaaaagatcgtacggaacagcgccgtaactggaaagcaattgagagtataaaagaactcaaagagggctatatcagtcaggctgtgcatgttatatgtcagcttgttgtcaagtacgatgcaatcatcgttatggaaaagctgactgacggattcaaacgaggcagaacaaagtttgaaaaacaggtttatcagaaatttgaaaaaatgctgattgacaaacttaattactatgttgacaaaaagcttgatcccgacgaagaaggcggtttacttcatgcctatcagcttacgaacaagcttgagagctttgataagcttggtacgcaaagcggttttattttctatgtccgtcctgattttacaagcaaaattgatcccgttaccggctttgtaaatttgttgtatcctcgatacgaaaaaattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttctttaaattattaagacttaccctacagatgcgaaacagtaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaagccgataatgtttcaactgtcgaaccggtaatccacaatgacaaatggctgaaatttgttcaggagaatgatatggcgaataattaa

SEQ ID NO: 124 - DNA, 3738 bp, Artificial Sequence
  Description of Artificial Sequence: Synthetic polynucleotide
atgcaggagcgtaaaaagattagccatctgacgcatcgcaactctgttaagaaaacgattcgtatgcagttgaacccagtcggaaaaacaatggactactttcaagcaaagcaaattttggagaacgacgagaagcttaaagagaactaccaaaaaattaaggagatcgctgatcgcttctatcgcaatctgaacgaggacgtgctttcgaagacaggtttggacaagttgaaggattatgccgagatttactaccactgcaatacggacgcagatcgtaaacgcttaaacaagtgcgctagcgagcttcgcaaagaaatcgtcaaaaactttaaaaaccgtgatgaatataacaaactgttcgataagcgcatgattgaaatcgtgctgccgaagcatttaaaaaatgaagatgaaaaggaagttgttgcgtcattcaaaaattttacgacgtatttcacgggcttctttactaatcgcaaaaatatgtattccgatggagaggaaagtaccgctatcgcctatcgctgtatcaatgagaatttacccaagcacttggacaacgtgaaggcctttgagaaagctatttccaaactgtccaagaatgcaatcgatgaccttgacgcgacatattcagggctttgcggaaccaatttatatgatgtcttcactgtggactattttaacttcttattgcctcaatccgggatcaccgagtataataaaatcattggaggctatactaccaacgatggtacaaaggttaaaggcattaacgaatatatcaacttatacaatcagcaggtatcgaaacgtgacaaaattccgaatttacagattttatacaagcagatccttagtgaatcagagaaggtctcttttattccccctaagttcgaagacgataatgagcttttaagtgcagtttcagagttctatgccaatgacgagactttcgacgggatgcccttaaagaaagcgattgatgaaactaaattgctttttggcaatctggataactcatcccttaatgggatctacattcaaaatgatcgttccgtaaccaacttgagtaacagtatgtttggaagctggtcagtgattgaagacctttggaacaaaaactacgactctgttaattctaattctcgcattaaggatatccaaaagcgtgaagacaagcgcaagaaagcttataaagcagagaaaaagttgagccttagtttcttacaagtcctgatctccaactctgaaaatgatgaaattcgcaaaaaatctattgttgattattacaagacttcccttatgcagcttactgataatttgagcgataaatacaatgaggctgcaccgcttttaaatgaaaactatagcaatgaaaagggtttaaaaaatgacgataaatccatctcccttatcaaaaacttcttagatgcaattaaggaaattgagaaattcatcaagccattgagcgaaacgaatattacgggtgagaagaatgacttgttctattctcagtttacaccattgctggataacatttcgcgcattgacattctttatgataaggttcgtaattatgtaacacaaaaaccattttccacggataaaattaagttgaacttcggcaactatcaacttctgaacggctgggacaaggataaggagcgcgagtacggggcggtcctgctttgcaaagacgaaaagtattacctggcaatcatcgacaaatcaaataatcgtattttggagaatattgattttcaggactgcgacgaatccgactgttacgaaaagatcatttataaactgctgccgacccccaacaagatgttgccaaaggtgttttttgcgaaaaagcataagaaacttctgagcccatctgacgagattctgaagatctacaaaaatggtacatttaaaaaaggggataagttttcattggacgactgtcataagcttatcgatttttacaaagaatcatttaagaagtacccgaaatggctgatctataattttaagttcaaaaagactaacggatacaacgacattcgcgagttttacaacgatgtagcgctgcaaggctacaacattagtaaaatgaagattccgacctctttcattgataaattagtagatgagggtaaaatctatctgtttcaattatataataaggatttctctccacactcgaaggggacaccgaatttgcacacgttgtactttaagatgctttttgacgagcgcaatctggaggatgtcgtttatcgtttgaacggggaagcggaaatgttctaccgtccggccagtatcaagtatgacaaacccactcaccccaagaacacacctatcaagaataagaacactctgaacgataagcgtgcctctacttttccatatgatcttattaaggataagcgctatacgaagtggcagttcagtttgcatttcccaatcaccatgaatttcaaagatccagataaggccatgattaacgatgacgtccgcaatttattgaaatcgtgcaataataattttattatcggcatcgaccgcggggagcgtaatttactgtatgtctcagtaatcaacagtaacggcgctattatttaccagcattcattgaatatcatcggtaacaaatttaagggtaaaacatacgaaacaaactatcgcgaaaagcttgccacgcgtgaaaaggatcgcacagagcagcgtcgcaactggaaagctatcgagtccattaaagaattgaaggagggatacatttcccaagccgttcatgtcatttgtcaattagttgttaagtatgacgcgatcatcgtgatggagaaattgacggatggattcaagcgtgggcgtacgaaatttgaaaagcaagtgtaccaaaaattcgaaaaaatgttaatcgacaagttaaactactatgtagataagaaacttgatccagatgaagaggggggactgcttcatgcgtaccagttgacaaacaaactggaaagcttcgacaagttgggtactcaatccgggttcattttttatgtacgtcctgactttacaagcaagattgacccggtaaccgggtttgtaaatttgctgtaccctcgctacgagaaaattgataaagcaaaagatatgatctcgcgcttcgatgacattcgctataacgccggcgaggactttttcgaatttgatatcgattacgataagtttccaaaaacagcaagcgattatcgcaagaagtggactatttgcaccaatggagagcgtatcgaggctttccgtaatccagcaaacaataacgaatggtcttaccgtactattatcctggcggaaaagtttaaagagctttttgacaataactcaattaactaccgcgacagtgatgacttaaaggcggagattttatctcaaactaagggaaaattctttgaggacttcttcaagttattgcgtctgaccttacaaatgcgtaatagtaatcccgaaacaggagaagaccgcatcttgtctccggtcaaggataagaatggaaacttttacgatagctctaaatacgacgagaaaagtaaacttccgtgtgacgcagatgcgaatggtgcttataacattgcacgtaaaggcctttggattgtcgaacaatttaagaaggcggacaatgtatccaccgtagaacccgtgatccataatgataaatggctgaaatttgtgcaggaaaatgacatggcgaataactaa

SEQ ID NO: 125 - DNA, 3738 bp, Artificial Sequence
  Description of Artificial Sequence: Synthetic polynucleotide
atgcaagagcgcaaaaagatctctcatttaacgcatcgcaattcggtcaaaaagacgatccgtatgcaactgaaccctgttggtaaaacgatggactactttcaagccaaacaaatccttgaaaatgacgaaaaattaaaggagaactaccagaaaatcaaagagattgcggatcgcttctatcgtaatttgaacgaggacgtcctgtccaaaacagggttggacaaacttaaagactacgcagagatttactaccactgcaacactgatgcggaccgtaagcgtttgaataaatgtgcaagtgaattgcgcaaagagatcgtaaagaactttaagaatcgcgatgagtataataagttgtttgacaagcgtatgatcgaaatcgtgcttcctaagcatttaaaaaacgaggacgaaaaagaggttgtggcgtccttcaaaaatttcactacctattttacgggcttctttacaaatcgtaaaaatatgtatagcgatggcgaagagagcaccgcaattgcctaccgctgtatcaacgaaaacttgcctaaacacctggacaacgtgaaagccttcgaaaaggctatctcaaaactgtcaaaaaatgctatcgacgatttggacgcaacctattcggggttgtgcgggactaatttatacgacgtatttaccgtcgattacttcaacttcttgttaccccaatctggaatcacagagtataataagatcatcgggggctatactactaacgatgggactaaagtcaaaggtatcaatgaatacattaacttgtacaaccagcaggtatctaaacgtgacaaaattccgaacttgcagatcctttataaacagattctttctgagagcgaaaaagtatcctttattccacctaagtttgaggacgataatgagctgttaagcgcagtctcggaattctatgcgaacgacgagacctttgacggtatgccgttgaagaaagctattgacgagacaaaactgttatttgggaacttagataattccagcctgaatggcatttatatccaaaatgaccgcagtgtcactaatctttcgaactctatgttcgggtcctggagtgtaatcgaggacttgtggaataaaaattatgactcggttaattctaattcacgcattaaggacatccaaaaacgtgaagataaacgcaaaaaagcgtacaaggccgaaaagaaactgtccctgtcgttcttacaggtccttatctccaattcggagaatgatgagattcgcaagaagtcaatcgttgactactataaaacttctttaatgcagctgaccgataatttgtctgacaaatataacgaggcagcaccgttattgaacgagaactattcgaatgagaaagggttaaaaaacgacgataaatcgatcagtctgatcaaaaattttttggatgcaattaaagaaatcgaaaagttcatcaagcccttatccgagaccaacattacaggcgaaaagaacgatctgttttactcgcaattcactccgttgttagataatatcagtcgcatcgatatcttgtacgataaagtacgtaattatgtgacacagaaaccgttctcgaccgacaagatcaagttgaattttggaaactaccaattattgaatgggtgggacaaggacaaagagcgcgaatatggagctgtcttgctgtgtaaagatgaaaaatactatcttgccattatcgacaagtccaacaaccgcattctggaaaacattgacttccaagattgtgatgagtcagactgctacgagaagatcatttataaactgttgcccactcctaacaagatgctgcctaaggtttttttcgcaaagaaacacaaaaaactgctttccccgtccgatgagatcctgaaaatctacaaaaacgggacgtttaagaaaggagacaaattctcgcttgacgattgccataagctgatcgatttctataaagagtctttcaaaaaatatcccaagtggttaatttataattttaaattcaagaagacgaatggctacaacgatattcgcgagttttataatgacgttgctttgcaaggatataacatttccaaaatgaagatcccaacatcctttatcgataaattagttgatgaagggaagatctacctgtttcaactgtacaataaagacttttcgccacactcaaaaggaactcccaacttacatacgttatatttcaaaatgttattcgatgaacgtaacttggaagatgttgtctaccgtcttaatggcgaggctgagatgttctatcgtccagccagtattaaatacgacaagccaacccaccctaaaaacacacctattaaaaacaaaaacacactgaatgataagcgcgccagtacattcccatatgatttgatcaaagacaaacgctacactaaatggcagttcagtcttcatttcccaatcactatgaatttcaaagacccagataaggccatgatcaatgatgatgtacgtaatcttttgaagtcttgcaataataacttcatcattggtattgaccgcggcgagcgcaaccttttatatgtgagcgtaattaactcaaacggcgccatcatttatcaacactcccttaacattattggcaacaagtttaaagggaaaacgtatgaaacaaattaccgtgagaaattggctacccgcgaaaaggaccgcactgaacagcgccgcaactggaaggcgatcgaaagcattaaggagttaaaggaagggtacatcagccaggcagtgcacgttatttgccaattggttgtcaaatatgatgctattatcgttatggaaaaactgaccgacgggttcaaacgtggacgcaccaagttcgagaagcaagtgtaccaaaagtttgaaaaaatgttaattgataagttaaattattatgttgataagaaattagatccagacgaagaaggcggtttacttcatgcttatcagcttacaaataagttggaaagctttgataagctgggtacgcagtccggatttattttttacgtgcgtccggacttcaccagcaagatcgatccagtcacgggtttcgttaatcttctttacccgcgctatgagaagatcgacaaggcaaaggacatgatctcacgctttgacgacattcgctacaacgccggggaagacttttttgagttcgatattgactacgacaagttccctaaaacagcctcggattatcgtaagaagtggaccatctgtactaatggtgagcgtatcgaagcattccgtaatcctgctaataacaacgaatggagctaccgcactattattttggccgaaaaattcaaggaactgtttgataacaattcgatcaattatcgcgactcagatgaccttaaagcagaaattttatcccagacaaaaggcaagtttttcgaagatttcttcaaattattgcgccttacgttgcagatgcgcaatagcaatcctgagacgggggaagaccgtatcttaagccccgtgaaggataaaaacggcaatttctacgactcgtccaaatatgatgaaaagagcaaacttccgtgtgatgctgacgctaatggggcatacaacatcgcccgtaaagggctgtggattgtggagcagttcaagaaagcagataacgttagtaccgtcgaacctgtcattcacaacgataaatggttgaaattcgtacaggagaacgatatggcgaacaattaa

SEQ ID NO: 126 - DNA, 3738 bp, Artificial Sequence
  Description of Artificial Sequence: Synthetic polynucleotide
atgcaagagcgtaagaagatttcccacttgactcatcgtaattctgttaaaaaaaccattcgtatgcaattaaacccggtcggtaagactatggactactttcaggccaagcaaatcctggaaaacgatgaaaagttgaaggaaaactatcaaaaaattaaggaaattgctgaccgcttttatcgcaacttaaacgaggatgtgttgtcaaaaaccggccttgacaaattgaaggactacgccgaaatttattaccattgtaatacggacgccgatcgtaagcgcttaaacaaatgtgcgagcgagcttcgtaaggagattgttaaaaatttcaaaaatcgcgatgagtacaacaagcttttcgacaagcgtatgattgaaatcgtcttgcctaaacatttgaagaatgaagacgaaaaggaagtcgtagcatcctttaagaactttacgacgtactttaccggtttcttcacaaatcgtaaaaacatgtactcggatggcgaagagtcaacggccatcgcttaccgctgtattaacgaaaatctgccgaaacatttggataatgttaaagcattcgagaaggcaatctctaaattatcaaaaaacgccatcgacgatctggacgccacctacagtgggttatgcggcacgaacttatacgatgtgttcactgtagactactttaacttcttattgccccaaagcggcatcaccgaatacaacaaaattattggtggctacacgacgaacgatggtactaaggtgaaaggaatcaacgaatacatcaacttgtacaatcaacaggtttccaaacgcgataagattcccaatttacagatcttatataagcaaattctgtccgaatcagagaaggtgtcctttattccaccgaagttcgaggatgataatgagcttttatcggcggttagcgagttttatgcaaatgatgaaacttttgacggcatgccccttaaaaaagccatcgatgagacaaagttgttgtttggcaacttagacaattcttctctgaacgggatttacattcagaacgaccgttcggtgacgaatttaagcaacagtatgtttgggagttggagcgtcatcgaagacctttggaataaaaattatgatagtgtgaactctaatagtcgcattaaagatatccagaagcgtgaagataaacgcaaaaaggcctataaggctgagaaaaagctgtctctttcttttttacaggtactgatttctaactccgagaacgacgagattcgtaagaagagtatcgttgattactataagacgtcgttaatgcaacttacagataacttgtcggacaaatacaacgaagccgctcctttactgaacgaaaattattctaatgagaaaggtttaaagaacgatgataagtctatctcacttatcaagaacttccttgacgccatcaaggaaattgaaaaattcatcaaaccgttgtccgagaccaacattaccggtgaaaagaatgacctgttttacagtcaattcaccccactgcttgacaacatcagccgtattgacatcctgtacgataaggttcgtaactacgtgactcagaagcctttctccacggataaaattaagttgaacttcggaaattaccagcttttgaacggatgggataaggacaaagaacgtgagtacggtgctgttttgttatgtaaggacgaaaaatactatcttgcgattattgacaagtctaataatcgtattcttgaaaacattgactttcaagactgtgatgagagtgactgttatgaaaaaatcatttataaacttctgcccacgccaaataaaatgcttccgaaagtcttcttcgcaaaaaaacataagaagttactttcgcctagtgatgaaatcttgaaaatctataaaaacggcacctttaagaagggtgacaaatttagcttagacgattgccacaaactgatcgacttctacaaggagagtttcaaaaaatatccgaaatggctgatttacaattttaagtttaaaaaaacaaacggatataacgacattcgcgaattctataatgatgttgccctgcaggggtataatatttcaaaaatgaagattcctactagttttattgacaagttggtagatgaaggaaaaatttatctgttccaactgtacaataaagatttttcgccacattcaaaaggaaccccgaatcttcatactttgtattttaagatgttgtttgacgagcgtaaccttgaggatgtcgtttatcgtttgaacggcgaagcagagatgttttaccgcccggcgtccatcaagtatgataagccaactcacccgaagaacactccaattaaaaataagaatacattgaatgataagcgcgccagtacctttccttatgatttgatcaaggacaaacgctacacaaagtggcaattcagtcttcactttccaattacgatgaactttaaggaccctgataaggcgatgattaatgatgacgtccgtaatctgttaaaatcttgcaacaataatttcatcattggaatcgaccgtggggaacgcaatctgctgtacgtttccgttatcaatagtaacggagcaattatctaccagcatagcttgaacattatcggaaacaagttcaaaggtaaaacatacgaaactaattaccgtgaaaaactggccacacgcgaaaaggatcgcaccgagcagcgtcgcaattggaaagccatcgaatctatcaaagaactgaaggagggttatatttcgcaggctgtccatgtaatttgtcagttagtagtcaagtacgacgccatcatcgtaatggagaagcttactgacggatttaaacgtggacgcacgaaatttgaaaaacaggtatatcagaagtttgaaaaaatgctgatcgacaagcttaattattatgtggacaagaaattagatccagacgaggagggggggttattacatgcatatcagctgacgaataaactggagagttttgataagttagggactcaatcgggctttatcttttatgtacgtccagattttacttcgaagattgaccctgtgacggggtttgtaaacctgttatatccccgctacgagaaaattgataaggcaaaagatatgattagccgcttcgacgacattcgctataatgctggagaagattttttcgaatttgacatcgattatgataagttcccaaagacagcctcggattaccgtaagaagtggactatctgtactaacggggagcgtattgaagcatttcgtaaccctgcgaataacaatgaatggagttaccgcacaattattcttgctgaaaaatttaaagaattatttgacaacaattcgattaactatcgtgattccgacgatcttaaggcggaaattctttcacaaacgaaggggaagttcttcgaggatttctttaagcttcttcgcttgactttacagatgcgtaactctaaccccgaaaccggcgaagatcgtattttgagtcctgtgaaggataaaaacggtaacttttacgacagctcgaaatacgatgaaaagagtaaacttccatgtgacgcggacgcaaatggggcatacaatattgcgcgtaaggggttgtggattgtggaacagttcaaaaaggcggataacgtatccacggtagaacccgtaatccataacgataagtggttaaagttcgtgcaagaaaatgacatggctaacaactaa

SEQ ID NO: 127 - DNA, 3738 bp, Ruminococcus sp.
atgcaagagcgtaaaaaaatatcgcatcttacacacagaaattcagttctaaaaacaattgggatgcaactgaatcctgtaggtaaaacaatggattattttcaagcaaagcaaattcttgaaaatgatgaaaagcttaaagaggactatcagaaaatcaaggaaatagcagacaggttttacagaaatttaaatgaggatgtactttcaaaaaccgggttagataaattaaaagattatgctgaaatttactatcactgtaatacggatgcagaccgaaaaagacttaataaatgtgcatcggaattaaggaaagaaatcgtcaaaaattttaagaatagagatgagtataacaaactattcgataaaaggatgattgagatagttcttcccaagcatcttaaaaatgaggacgaaaaggaagttgtagcctcatttaaaaatttcacaacatactttacaggtttcttcactaacagaaaaaatatgtattcggacggagaagaatccacggcaattgcatatagatgcattaacgaaaatttgcctaagcatcttgacaatgtcaaggcctttgaaaaagcaatttctaaactatccaaaaacgcaattgatgatttagatgccacttattccggcttatgcggtacaaatttgtatgatgtttttacagttgattattttaactttttgcttccacaatccggaattaccgaatataacaaaatcatcggcggttacacaacaagcgacggtacaaaagttaagggtattaacgaatatataaatttgtacaatcaacaagtatccaaacgggataaaattcctaatcttcaaattttgtataaacaaattttaagtgagagtgaaaaggtatcattcataccgccaaagtttgaagatgacaacgaacttttatcggctgtttcagagttttacgcaaatgacgaaacctttgacgagatgccattaaaaaaagcaattgatgaaacaaagctattattcggcaatttagataattcctctcttaatggaatttacattcaaaatgaccgatccgtgacaaatctgtcaaacagtatgttcggttcttggtcagtaatagaagatttatggaacaaaaattatgactccgttaattcaaacagcagaatcaaagatattcaaaagcgtgaagacaaaagaaaaaaagcatacaaagcagaaaagaaactttcactttcatttttacaggttttgatttccaattccgaaaataatgaaatcagagaaaagtctatcgtagattactacaagacttctttaatgcaacttaccgacaatttgtcagacaaatacaacgaagtagcacctctgctcaatgagaattactctaatgaaaaaggtttgaaaaatgacgataaatctatttcattaattaaaaattttcttgatgccataaaagaaattgaaaaattcatcaagcctttgtccgaaactaatattacaggtgagaaaaatgatttgttttacagtcagttcacaccattacttgataatatcagcagaatagacatattatatgataaggtcagaaactatgttacacaaaaaccgttttcaaccgataaaatcaagcttaactttggcaattaccagctattaaacggctgggataaagacaaagaaagagagtacggagccgttttgctttgtagggatgaaaagtattatcttgcaatcatagataaaagcaataatcgtattttggaaaatattgattttcaagactgcgatgaaagcgattgttacgaaaagataatttacaagcttctccccactccaaataaaatgcttccaaaagttttctttgcaaaaaaacacaaaaaacttttgtcaccgtcagacgaaatacttaaaattcgtaaaaacggcactttcaaaaaaggcgataagttcagccttgatgattgccataagttaattgatttctacaaagaatcattcaaaaagtacccaaattggttaatttataactttaaattcaaaaaaacaaacgaatataacgatatccgcgaattttataatgatgttgctttacagggatataatatttcaaaaatgaaaatcccgacatcatttattgacaaacttgtagatgaaggaaaaatctatcttttccaactctacaacaaagacttttcaccgcatagcaagggtactcctaatctgcatacactttattttaaaatgttgtttgatgaaagaaatcttgaagatgtggtgtacaagcttaacggtgaggcaaaaatgttttatcgtcctgcaagtataaaatatgacaaaccaactcatcccaaaaacacaccgataaaaaataaaaatacactcaatgataaaaaagcaagcacttttccttatgacttaattaaagataaacgctacactaagtggcagttttcacttcacttctctattaccatgaattttaaagctccggataaggcaatgatcaatgatgatgtcagaaatctgctgaaatcctgcaacaacaatttcatcataggaattgacagaggcgaaagaaacttgctttatgtcagcgtaattgacagcaacggtgctataatatatcagcactcactcaatattatcggaaacaagtttaaaggaaaaacatacgaaactaactaccgggaaaaacttgcaacaagagaaaaagagcgtacggaacagcgccgtaactggaaagcaattgagagtataaaagaactcaaagagggctatatcagtcaggctgtgcatgttatatgccagcttgttgtcaagtacgatgcaatcatcgttatggaaaagctgactgacggattcaaacgaggcagaacaaagtttgaaaaacaggtttatcagaaatttgaaaaaatgctgattgacaaactgaattactatgttgacaaaaagcttgatcccgatgaagaaggcggtttacttcatgcctaccagcttacgaacaagcttgagagctttgataagcttggtacgcaaagcggttttattttctatgtccgtcctgattttacaagcaaaattgatcccgttaccggctttgtaaatttgttgtatcctcgatatgaaaacattgacaaagccaaagatatgatttcaagatttgacgatataagatacaatgccggcgaggacttttttgaatttgacattgattacgataagtttccaaagactgcgtctgactatcgcaagaagtggacaatctgtactaacggcgaaaggattgaagctttcagaaatcccgcaaacaataacgaatggagttatcgtacaataattcttgcagaaaaattcaaagaattatttgataacaattctataaattatcgtgattctgacgatttgaaagctgaaattctttcacagacaaagggcaaattttttgaggatttctttaaattattaagacttaccctacagatgcgaaacagcaaccctgaaacaggcgaggaccgtattctttctcccgtcaaggacaaaaacggcaatttttacgacagttcaaaatatgatgaaaagagcaagcttccgtgtgatgccgatgcaaacggtgcgtacaacattgcccgcaaaggtttgtggattgttgaacaattcaaaaaatccgataatgtttcaactgtcgaaccggtaatccacaatgacaaatggctgaaatttgttcaggagaatgatatggcgaataattaa

SEQ ID NO: 128 - DNA, 3738 bp, Artificial Sequence
  Description of Artificial Sequence: Synthetic polynucleotide
atgcaggaacgtaagaagatcagccacttaacacatcgtaacagtgttttgaagaccatcggcatgcagcttaatcctgtaggaaaaacaatggattatttccaagcgaagcaaatcttggaaaacgatgaaaaattgaaagaggattaccaaaaaatcaaagaaattgctgatcgtttctaccgcaatcttaacgaggacgtgctgtcaaagacaggcttggacaagttgaaagactacgccgaaatttactatcactgcaataccgacgccgatcgtaaacgtctgaataaatgtgcctctgagttgcgtaaagagattgtgaagaattttaagaatcgtgatgagtacaacaagttgttcgacaaacgcatgattgagattgtattgcccaaacatttgaaaaacgaggatgagaaagaggtggttgcctcattcaagaatttcaccacgtacttcacgggattcttcaccaatcgtaagaatatgtattccgatggagaggagtctaccgccatcgcctaccgttgtatcaacgagaaccttcctaagcatttagacaatgtaaaagcatttgaaaaggccatctctaaattgtcgaagaatgcgattgatgaccttgatgccacctattcggggctgtgcggcactaatctttatgacgtatttacggtggactatttcaactttcttttgccgcaatctggaatcacggagtataacaaaattatcggtggttacacgacttcggatggcaccaaagtcaaggggatcaacgagtacattaacctgtataaccagcaggtttctaaacgcgataagattccgaatttacaaatcctgtacaaacaaattttgtcagaatcggagaaggtatcgtttatcccgccgaaatttgaggatgataatgagctgttgtcggcagtaagtgaattttatgccaacgatgagaccttcgacgaaatgcccttgaagaaagcgatcgacgagacaaaacttctttttggaaatttggacaattcaagtctgaatggaatttacatccaaaatgatcgcagtgtcacaaacttgtcgaatagtatgtttgggagctggagcgttattgaagacctgtggaacaaaaactatgactcggtgaactctaactcacgcatcaaggacattcagaaacgcgaggacaaacgcaaaaaggcgtataaagctgagaagaagttaagcttgagttttttacaggttctgatttccaactccgaaaacaatgaaattcgcgagaagtcaatcgtggattattacaagaccagtttgatgcaattaacagacaacctgagcgacaagtacaatgaagttgctcctttattgaacgaaaattattccaacgagaaaggattaaagaatgatgataaatccatcagtttaattaagaactttctggatgctatcaaggagatcgaaaagtttattaagccactttctgagaccaacattactggagaaaaaaatgacctgttttactcgcaattcacacccttgttggacaatatcagccgtatcgatattttatatgataaggtgcgtaattatgttactcaaaagcccttttcgaccgacaaaattaaactgaactttgggaattatcaacttttgaatggatgggataaagacaaagaacgcgaatacggtgcagttctgctgtgccgtgatgagaaatattatttggcgattatcgacaaatccaacaatcgcatcttggaaaatattgacttccaagactgcgatgagagtgattgctatgagaagattatctataaattgctgcctacgccgaataagatgttaccgaaggttttcttcgcgaaaaagcataagaagcttctgtcgcccagtgacgagattttaaaaatccgcaagaatgggacattcaagaagggcgataagttctcgcttgatgactgccataagcttattgacttttataaagaatcattcaagaagtatccaaactggctgatttataattttaaattcaaaaagactaacgaatataatgatattcgtgaattctataatgacgtcgcgttgcaaggttataacattagcaagatgaaaatccccaccagcttcattgacaagttagtagatgaagggaaaatttatcttttccagctttataataaggatttttcaccgcactcgaaaggtacgcctaatctgcacacattgtattttaaaatgttattcgatgaacgtaatcttgaggatgtggtctacaagttaaatggggaggccaaaatgttctatcgcccagcgagcattaagtacgataaaccgactcatcctaaaaacaccccaattaagaacaagaacacattaaacgacaagaaagcttccacttttccttatgacttgattaaggacaaacgctatactaagtggcagttctcccttcacttctcgattaccatgaatttcaaggctcctgataaagccatgattaacgacgatgttcgtaatcttttaaagtcgtgtaataacaacttcatcatcggcattgatcgcggagaacgcaatcttttgtacgtttccgtcatcgattcgaatggtgctattatttaccagcactctcttaatattattggaaataagttcaaaggcaagacatacgagacaaattaccgcgagaaattggccacacgtgaaaaagagcgtaccgaacagcgccgtaattggaaggcgattgagagcatcaaagaattgaaggaaggctacattagtcaggcagtgcacgtgatttgtcaactggttgttaagtacgatgctattattgtaatggaaaagttaacggacggttttaaacgcgggcgtacaaagttcgagaagcaagtatatcaaaagttcgaaaaaatgttgattgacaaacttaactattatgtggacaagaaactggatccggacgaagaggggggtttgttacacgcgtaccagttgaccaacaagttagaaagcttcgataaattggggacccaatctggtttcattttctatgtccgccccgactttacctcaaagattgatcctgtaactgggtttgtgaacttattatatccgcgctatgagaacatcgataaagcaaaagacatgatttcacgctttgatgatattcgctacaacgctggggaggacttttttgaattcgatattgactacgataaattcccgaaaacagcttcagattatcgtaagaagtggacgatttgtacgaacggcgaacgtatcgaggctttccgcaacccagctaataacaatgagtggtcgtatcgtactattattttggctgagaaattcaaagaactttttgacaataactctattaactaccgcgattctgacgaccttaaagcggaaattcttagccagacaaaaggaaaattcttcgaggacttcttcaaactgctgcgtctgaccctgcaaatgcgtaattccaatcccgagactggggaagaccgtatcctgagcccagtgaaggataaaaacggtaacttctacgattcatcaaaatatgatgagaaaagtaagttaccatgcgacgcagatgctaacggtgcgtacaacattgcgcgtaaaggactttggatcgtagaacaatttaaaaagtcagataatgtgtctacggtggagcccgtaattcataatgacaaatggcttaagttcgtgcaggaaaatgacatggcgaacaattaa

SEQ ID NO: 129 - DNA, 3738 bp, Artificial Sequence
  Description of Artificial Sequence: Synthetic polynucleotide
atgcaagagcgtaaaaaaatcagccacttgactcaccgtaatagtgtgttaaaaacaatcggaatgcagcttaatcccgtaggtaagaccatggattactttcaggcgaaacaaattttggaaaacgatgaaaaacttaaggaagattaccagaagattaaagagatcgctgatcgcttttatcgcaacttgaatgaagacgttttaagtaagacaggcctggacaaacttaaggactacgctgagatttattaccattgcaatacagacgccgatcgcaagcgtcttaataagtgcgcgtccgagcttcgtaaggagattgtgaagaacttcaagaaccgcgatgaatataataaattgtttgataaacgtatgatcgagattgtcttgccaaaacacttgaagaacgaggacgagaaagaggtggtggcatcttttaagaatttcacgacatatttcactggcttctttacaaatcgcaaaaacatgtatagtgacggtgaggagagcacggcaattgcttaccgctgtatcaacgagaatttgccaaaacacttggacaatgtcaaggcgtttgagaaagctatttcaaaactgtcgaaaaatgccatcgacgatcttgacgcaacctactcagggctttgtggaacaaacctgtatgatgtttttactgtagattacttcaacttcttgttgccacaaagtgggattaccgaatacaataagattattggcgggtataccacatcagacggcacaaaagtgaagggaatcaatgaatacatcaatctgtataaccaacaggtttctaaacgtgacaagattccgaaccttcaaatcttatataagcaaatcttatctgaatctgagaaagtttcattcatcccacctaagtttgaggacgataatgaactgctttcggccgtaagcgagttctatgcaaacgatgaaacatttgacgaaatgcctttgaagaaggccatcgacgagactaaacttctttttggcaaccttgacaactcgtcattgaatgggatctatatccaaaatgaccgttctgtgacgaatctttcgaattcgatgtttgggtcgtggtcagtcattgaggatctttggaacaaaaattacgacagtgtcaatagtaatagccgtatcaaagacatccagaaacgcgaagataaacgtaagaaggcctataaagctgagaagaagctgtcactgagttttttacaagttttgatcagtaattcggagaacaacgagatccgcgaaaagagtattgtggattactataaaacgtcgcttatgcaattaacagacaatctttcagataagtataacgaagtcgccccacttctgaatgagaattacagtaacgaaaaaggcttaaaaaacgacgacaaatctatctctcttattaagaacttcttggatgctatcaaagagattgaaaaattcattaaaccactgtcagaaacgaacattacaggagagaagaatgatctgttctatagtcaattcactccattgttagacaatattagccgtatcgatattttatatgacaaggtccgcaactatgtcacgcaaaaaccattttctactgataagattaaattgaatttcgggaactaccaattactgaacgggtgggataaggataaagagcgcgaatacggcgccgtgttactgtgccgtgatgaaaagtactacttggctatcatcgacaagtctaataaccgcattttagaaaatattgacttccaggactgtgacgaatcagattgttatgagaagattatttataaattattacctacgcctaataagatgttacctaaagtatttttcgctaaaaaacacaagaagcttctgtctccgtcagatgagatcctgaaaatccgtaagaacgggacctttaagaaaggagacaaattcagtctggacgattgccataaattgattgacttctataaagagagcttcaagaaataccccaactggttaatttataatttcaagtttaaaaaaacaaatgaatataacgacattcgtgaattctataacgatgttgcattgcaaggttacaatatctccaaaatgaagatccctacatcgttcatcgataaattggtcgacgagggaaagatttacttgttccagctgtataacaaggatttttcgcctcactctaagggcacgccgaacttgcatacgttatacttcaagatgttattcgacgagcgtaatcttgaggacgtggtgtataagttaaatggtgaggccaaaatgttttatcgcccggcatcaattaagtatgataaacctacccatcccaagaatactccgatcaagaataagaatacgctgaacgataagaaggccagcacttttccctatgatttgatcaaagataaacgttacacaaagtggcagttttctcttcatttttcgatcactatgaacttcaaggcgcccgacaaagctatgatcaatgatgacgtccgtaatttgttgaagagctgtaacaataattttatcatcggcatcgaccgcggtgaacgtaatcttttatatgtttcagttatcgacagcaacggggctattatctaccaacactcgttaaatattattggaaataagttcaaaggcaaaacctacgaaacaaattatcgcgaaaaactggcaacgcgcgagaaggaacgtacagaacagcgccgtaattggaaggccatcgagagtattaaggaattgaaagagggatacatttcgcaagcagttcacgtgatctgccagttagtagtcaaatacgatgctattatcgtcatggagaagttaactgacggattcaagcgtgggcgtaccaagttcgagaaacaagtatatcaaaagttcgaaaagatgctgattgacaagcttaactattatgtggataagaagctggaccccgacgaagagggcggtcttcttcatgcgtatcagttaacgaataaattagaatctttcgacaaacttgggacacaatctgggttcatcttttacgtccgcccggatttcacaagcaaaattgatcctgttactggattcgtaaacttgctttatccccgctatgagaatattgataaagcaaaggatatgattagtcgttttgatgatatccgctataatgcaggtgaggacttttttgaattcgatatcgactacgacaaatttcctaagactgcttccgactatcgtaagaaatggacaatttgcacaaacggtgagcgcatcgaggcttttcgcaatcccgcaaacaataacgaatggtcatatcgcacaattatcttggctgaaaagttcaaagaactgttcgataacaatagtattaactatcgtgattcagacgatcttaaggctgaaatcctgtcgcaaacgaaaggcaagttctttgaagatttcttcaagcttttgcgtctgacacttcaaatgcgcaattcaaatcctgagactggagaagatcgcattctgtccccagtcaaagataagaatgggaacttctacgactcatctaaatacgacgagaagagtaaacttccatgtgacgcagatgcgaatggtgcgtataacatcgctcgtaaaggcttgtggattgtggaacagttcaaaaaatccgataatgtttcaacagtagagccggtgatccacaatgacaaatggttgaagtttgtgcaagagaatgacatggccaataactaa

SEQ ID NO: 130 - DNA, 3738 bp, Artificial Sequence
  Description of Artificial Sequence: Synthetic polynucleotide
atgcaagagcgtaagaaaatcagccacctgacgcatcgtaactccgtcttaaaaacaatcggtatgcagctgaaccccgtgggaaaaaccatggactacttccaggcaaaacagattcttgagaatgatgaaaaattaaaagaagactatcaaaagatcaaggaaatcgcggatcgcttctatcgcaatcttaatgaggatgtgttatcgaaaaccggacttgacaagcttaaagactatgcagagatttactatcattgtaatacggatgcagaccgcaagcgtttaaataaatgcgcatctgagcttcgcaaagaaattgtgaagaatttcaagaatcgtgatgaatataacaaattgttcgacaagcgtatgattgagattgtgttgcccaagcatctgaaaaatgaggacgagaaagaagtcgttgcatctttcaaaaactttacgacgtatttcactgggttttttaccaatcgtaagaatatgtattctgatggagaagaaagtacggccatcgcctatcgctgcattaacgagaatttacccaagcatttggacaatgttaaagcattcgaaaaggccatttctaaacttagtaaaaatgcgatcgatgatcttgacgccacatatagtgggttgtgtggtacaaacctttatgacgtgtttaccgtagattatttcaatttcttacttcctcaatctggcattacggagtataataaaattatcggcggctatacgacaagcgatggaacgaaggtaaaagggatcaatgagtacatcaatttgtataaccagcaggtgtccaaacgtgacaagatcccaaatttgcagatcttatacaaacaaattctttcagagtctgaaaaagttagttttattccccctaagtttgaggacgacaacgagctgctttccgcagtgtcggaattttacgcaaacgatgagacttttgacgagatgccattgaagaaggcgatcgacgagaccaagttgttatttggaaacttagacaattcttccttgaacggcatctacatccaaaacgatcgtagtgttaccaatttatccaactcgatgtttgggtcatggtcagtcattgaggacctttggaataagaattacgacagcgtcaatagcaactctcgcatcaaagatattcagaaacgcgaagataagcgtaaaaaggcctataaggccgaaaaaaagttaagtctttcctttctgcaggtgttaatttcgaatagtgagaataatgaaattcgcgaaaaatcaattgttgactactacaaaacatccttaatgcaacttaccgataacttatccgataaatataatgaggtggccccattacttaacgaaaattatagcaatgagaaaggattaaagaacgacgataaatccatctctcttatcaaaaacttcttagatgcaattaaagaaattgaaaagttcattaaaccattaagtgagaccaacatcacaggcgaaaagaatgacttgttctactctcaattcacgccccttttggataacattagtcgcattgacatcttgtacgacaaggttcgtaattacgttacacaaaaaccgttttcgactgacaaaattaagctgaattttggtaattaccagttacttaatggttgggataaagataaagagcgtgagtacggagccgttttgttatgccgcgatgaaaagtactaccttgccatcatcgataagtcgaacaatcgtatccttgaaaacattgacttccaggactgcgacgagtccgactgttacgaaaaaatcatttataaacttttaccaacaccaaataagatgttaccgaaagtgttctttgcgaaaaaacacaaaaaactgttatcgccgtcagatgaaatcttaaaaatccgcaagaacgggacatttaaaaagggcgacaaattcagtttagacgattgccataagcttatcgatttctataaagaatcatttaagaaataccccaactggctgatttataactttaagttcaagaaaactaatgagtacaatgacattcgcgagttctataatgacgtagcgttgcaagggtacaacatctccaagatgaaaattcctacttctttcatcgataaactggttgacgagggtaagatctacttatttcagctgtataacaaggatttctctccccattcaaaaggaacacctaacttacatacgttatacttcaaaatgcttttcgacgagcgcaacctggaggatgtagtttataaactgaatggagaggcgaagatgttctaccgtccagccagcattaagtatgataaaccgacccaccctaaaaacacccctatcaaaaataaaaatactctgaacgataaaaaggcaagtacctttccctatgacctgattaaagacaaacgctatactaaatggcagttctctctgcacttcagcatcacaatgaattttaaagcaccggacaaggcaatgatcaacgacgatgtgcgcaatttacttaagagttgtaacaacaacttcattattggaatcgaccgcggcgagcgcaaccttctgtatgtctctgtcatcgactcaaatggtgccatcatctatcagcattcgttaaatattatcggcaataagtttaaagggaagacatacgagaccaattaccgtgagaaactggcgacccgcgagaaagagcgcactgagcaacgtcgtaattggaaagctattgaatctatcaaggaacttaaagagggctatatttctcaggcagtccatgtgatttgtcagcttgtagtgaagtatgatgcgattatcgtaatggagaaattaactgatggcttcaagcgcgggcgcaccaaattcgagaagcaggtataccaaaaatttgagaaaatgttgattgataaacttaactactatgtggataagaagctggaccccgacgaggagggcggacttctgcatgcataccagttaacgaacaaattagaatcatttgataaattaggtacgcaatctggcttcattttttacgtgcgccccgatttcacttcaaaaattgatccggtcacggggttcgttaatctgctgtatcctcgttatgagaacattgacaaagctaaggatatgattagccgttttgatgacattcgttataatgcgggcgaagacttttttgaatttgatatcgattatgataaatttcccaagacggctagcgactaccgcaaaaaatggacaatctgtacaaatggcgaacgcatcgaagcatttcgcaaccctgccaataacaacgaatggagttatcgcaccatcatcctggccgaaaagttcaaagagttgtttgacaacaacagcattaattaccgtgatagtgatgacttgaaagctgagatcctgtcacagactaaagggaagtttttcgaggattttttcaagctgttacgtcttactctgcagatgcgtaattcgaacccagagaccggtgaagatcgtatcttatcacctgtaaaagataaaaatggcaatttttatgatagttcgaaatacgatgaaaagagtaaattgccttgcgatgccgatgcgaatggagcttataacatcgcacgcaagggattatggatcgtggagcaattcaagaagtcagacaatgtgagcacggttgaacccgtgatccataatgataagtggttaaaatttgttcaagaaaacgacatggctaataattaa

SEQ ID NO: 131 - DNA, 3837 bp, Ruminococcus sp.
atgtcaatcaacattaacaaattttcagatgaatgtagaaaaattgattttttcactgatttatacaacattcaaaaaactttaagattcagccttattccaataggagcaactgctgacaactttgaatttaaaggcagattatccaaagaaaaagatttgctagattctgcaaagcgtatcaaggagtatatttcaaagtaccttgcagatgaaagtgatatatgtctttcccaacccgtaaagttaaagcatcttgatgagtactatgaactttatatcactaaagacagggatgaacagaagtttaagtctgttgaagaaaagttaaggaaagaattagccgatcttttaaaagaaattttgaaacgattaaataaaaagattttatctgattatctacctgagtatcttgaagatgacgaaaaggcccttgaagatatagcaaatctttcttctttctcaacttattttaacagttattacgataattgtaagaatatgtatacagataaggaacagtcaactgcaattccttatagatgtattaatgataatttacccaaatttattgataatatgaaagcatatgaaaaggctttagaagaactaaagccaagtgaccttgaagaacttagaaataactttaagggtgtatatgacacaacagttgatgatatgtttaccttggattatttcaattgtgttctttcacagtcaggtattgattcctacaacgctattataggtaatgacaaggttaaggggattaatgagtacattaatctccataaccaaactgcagaacaaggtcataaagtccctaacctaaaacgactatataagcagattggcagtcaaaaaaagactatttcttttcttcctagtaagtttgaaagtgacaatgaactcctaaaagcagtttatgatttctataataccggtgatgctgaaaagaacttcactgcattaaaagacactataactgaatttgagaagatttttgataatctatcagaatataaccttgatggtgtgtttgtaaggaatgatatttcacttactaatttatcacaaagtatgttcaatgattggtcagtattccgtaatttatggaatgaccaatatgataaagtcaataatccggagaaagcaaaagatattgataagtataatgacaagagacataaagtctataaaaagtcagaaagtttttcaattaatcagctacaagagttaattgcaacaactcttgaagaagatattaacagtaagaaaattacagattactttagttgtgattttcatagagttacaacagaagttgaaaataaatatcaactagtaaaagacttattatctagtgattatccgaaaaataaaaacctaaaaacaagcgaagaagatgtagcacttattaaggactttttagatagtgttaaatcattagaaagttttgtgaaaatactaaccggtaccggcaaagaaagtggcaaggatgaacttttctatggtagttttacaaaatggtttgatcagttgagatatattgataagctatatgacaaggtaagaaattacattacggaaaagccttattcacttgataaaattaagctgtcttttgataatccacagttcctaggtggatggcaacatagcaaagaaactgactattcagcacaactttttatgaaagatggattgtattatcttggtgtaatggacaaagaaaccaagagagaattcaaaactcagtataatactcctgaaaatgatagtgatacaatggttaagattgagtacaatcaaatcccaaatccgggtagagttattcaaaatcttatgcttgttgatggcaagattgtaaagaaaaacggtagaaagaatgctgatggtgttaatgctgttcttgaagaactaaagaatcagtatctacctgaaaatatcaatagaattagaaaaaccgaaagttataaaaccacaagtaataactttaacaaagatgacctaaaagcatatttagagtactatattgcaagaactaaggaatattattgcaagtacaattttgtttttaagtcagctgatgagtatggaagttttaatgaatttgttgatgatgttaacaatcaagcctaccaaattaccaaagtgaaagtatctgaaaaacaattactttcattagtagaacaaggcaaactttatcttttcaaaatctacaacaaggatttttctgagtatagtaagggtaagaaaaacttacatactatgtattttcaaatgctatttgatgacagaaatcttgaaaatttagtgtacaagctacaaggtggagcagaaatgttctatagacctgcaagtatcaagaaagattcagaatttaaacatgatgcaaatgttgaaattattaagcgtacttgtgaagataaagtaaatgataaagacaatcctacagatgatgagaaagctaagtattatagcaaatttgactacgatatagtaaagaacaaacgctttactaaagatcaattttctctacatttaactttagcaatgaattgtaatcagcctgaccattattggttaaacaatgatgttagagaacttctcaagaagtcaaataaaaaccatattattggtattgatagaggtgaaagaaatcttatctatgtaactataattaatagtgatggagtaatagttgaccaaatcaacttcaatattattgaaaacagttacaatggtaaaaaatacaaaactgattatcagaaaaaacttaatcaaagggaagaagatagacaaaaggcaagaaaaacttggaaaactattgaaacaattaaggaactgaaagacggttacattagtcaggttgtacatcaaatttgtaaacttattgttcaatatgatgcaattgttgtgatggaaaaccttaatggtggtttcaaaagaggtagaacaaaagttgaaaaacaagtttatcaaaagtttgaaactatgcttattaataagctgaattattatgttgataaaggtactgactataaagaatgtggtggacttttaaaggcatatcagcttacaaataagtttgaaacatttgaaagaatcggtaaacaaagtggtattatcttttatgttgacccatatctgacaagtaagattgacccggtaacaggttttgcaaatctgctttatcctaagtatgaaacaataccaaaaactcacaacttcattagcaatattgatgatattcgatataaccaaagtgaagattactttgagtttgatattgattatgataagttcccgcaaggtagttacaattatcgtaagaagtggacaatctgttcttatggcaacagaattaagtattacaaagattcaagaaataaaacagctagtgtagttgttgatattactgaaaagttcaaggaaacttttactaacgcaggtattgactttgttaatgataatattaaggaaaagttattgttagttaatagtaaggaactcctaaagtcatttatggatactcttaaactgactgttcagttgagaaattctgaaattaatagtgatgttgattacattatctcaccgataaaggatagaaacggtaacttctattatagcgaaaactacaaaaagtctaataatgaagtaccgtcacaaccacaagacggtgatgcaaatggtgcatataacattgcacgaaaaggattgatgattattaacaaactaaaaaaagccgatgatgtaaccaataatgagttgttgaaaatcagcaaaaaggaatggctggaatttgctcaaaaaggtgatttaggtgagtga

SEQ ID NO: 132 - DNA, 3837 bp, Artificial Sequence
  Description of Artificial Sequence: Synthetic polynucleotide
atgagtatcaatatcaataagttcagcgatgagtgtcgcaaaattgacttttttacagacctttacaacattcaaaagacactgcgttttagcttgatcccaatcggtgctacagcggacaactttgaatttaaggggcgcctttctaaagagaaggacctgcttgactcagccaagcgtatcaaggagtacattagcaagtacctggctgacgaatcggacatctgcttatctcaaccggtcaaattaaagcatttggacgagtactatgagttatatattaccaaagaccgcgacgaacagaaattcaagagtgttgaagagaaattacgcaaggagcttgccgatttgctgaaagagattttaaaacgcctgaacaaaaaaatcttaagtgattacttacccgagtacttagaggacgatgaaaaagcgcttgaagacattgctaatttgtcttctttttcgacttactttaattcatattatgataattgtaaaaatatgtacacagacaaagaacaaagtaccgcgattccttaccgctgtattaatgacaatttaccaaaatttatcgataatatgaaggcgtatgaaaaagctttagaggagctgaagcctagtgatttggaagaattgcgcaataactttaaaggcgtgtacgacaccaccgtcgatgacatgttcaccttggactatttcaattgtgtcctgtcccagagtggtattgactcttacaatgcgattattggcaatgacaaagttaaaggtatcaacgaatatatcaatctgcataaccagacagcagaacagggccataaagtcccaaacctgaaacgtctgtacaaacagatcggaagccaaaaaaaaaccatctcgttccttccatcaaaattcgaatcagataacgagcttcttaaggctgtctacgatttttataacacaggagacgctgaaaaaaacttcacggccctgaaggatacgattacagaattcgaaaagatttttgataacctgagcgaatataaccttgatggcgtcttcgtgcgcaatgacatttcgctgacaaatctgtcccagtctatgttcaatgattggtctgttttccgtaacctgtggaatgatcagtatgacaaagtaaataaccctgagaaagcaaaggatatcgacaaatacaatgacaaacgtcataaggtttataaaaaatccgaatccttctccattaatcagttgcaagaacttatcgcaacaacattggaggaagacatcaactcgaaaaagatcactgattacttctcgtgtgacttccatcgcgtaacgactgaagtggaaaacaagtaccaactggtaaaagacctgttgtcttcagattatcccaagaacaagaatttaaagacaagtgaagaagatgtggcacttattaaagatttcttagattctgtcaagtcccttgaatccttcgtaaaaattctgacaggcacgggtaaggagagtggaaaagacgagttgttttacggtagtttcacgaaatggtttgatcagcttcgctatatcgataagttatacgataaggtacgcaactacatcacggagaaaccatattcccttgataagattaagttatcctttgacaatccccaattcttaggtggatggcagcactctaaggagacagattattccgctcaactgttcatgaaagacggtctgtactatttaggtgtcatggacaaagaaacaaagcgtgaattcaagacacaatacaacacacctgaaaatgattccgatacaatggtaaagatcgagtacaaccaaattcctaaccctggtcgcgttatccagaatttaatgttagttgatggcaagattgttaagaaaaatggtcgcaaaaatgccgatggcgttaatgctgtacttgaagagttgaaaaaccaatatttacctgagaacattaatcgtatccgtaagacggaatcttataagacaacttcgaataatttcaataaggacgaccttaaagcgtacttagaatattacatcgctcgcacaaaagagtactactgtaaatacaacttcgtgttcaagagtgcggatgaatacggcagtttcaatgagtttgtggacgatgtcaacaatcaggcgtatcagattactaaagtaaaagtgtctgaaaaacaacttttgtcgcttgttgaacagggcaaattatacctgtttaaaatctataataaggattttagcgaatattcgaaaggaaagaaaaatctgcacaccatgtacttccaaatgctgtttgatgaccgcaatcttgagaatttagtttataagttgcagggtggggctgagatgttttaccgtccagcgtcaattaaaaaagactcggagtttaagcatgacgcaaatgtcgaaattattaaacgcacgtgcgaggacaaggtaaacgataaggataacccaacggacgacgagaaagcaaaatattattctaagttcgattacgacattgtgaaaaataagcgcttcaccaaggaccaattctcacttcatcttacattggcaatgaattgcaatcagcccgatcattattggttaaataacgatgttcgcgagttattgaagaagagtaataagaaccacattatcggtatcgaccgtggcgagcgcaatttgatttatgtaactatcatcaacagtgacggtgtgattgtcgatcagattaactttaatattatcgagaactcttataacggcaagaaatacaagacagactatcaaaaaaagctgaatcaacgcgaagaagatcgtcaaaaggcacgtaagacctggaagaccatcgagacaatcaaagagttaaaggatggctacatttcacaggtcgtgcaccaaatttgtaaattgattgtgcagtatgatgcaattgtagtcatggaaaatttgaatggtgggttcaaacgcggtcgcaccaaggtcgaaaagcaagtctatcagaaattcgagaccatgcttatcaataaacttaattattacgttgacaagggaacagactacaaagaatgcggcggattattaaaagcgtaccaattgacaaacaaatttgagacgttcgaacgtatcggcaagcaaagcggtattatcttttacgtggacccttacctgacttctaagatcgatcctgtaacgggcttcgcgaacctgttatacccgaaatatgagacgatccccaaaactcacaacttcatctccaatatcgacgacattcgttataatcaaagcgaagactactttgagttcgatattgattacgacaaatttccacagggctcctataactatcgcaagaaatggactatttgtagttatggaaatcgcattaaatattacaaagatagtcgtaataaaactgcgagcgtcgtagtagatatcacagagaagttcaaggagacttttactaatgccgggattgacttcgtcaatgacaacatcaaggaaaagttattgctggtaaactcgaaagaattgctgaaaagttttatggatacgttgaagttgacagtacagttgcgcaactcagaaatcaatagtgatgtggactatattatttcccccattaaagaccgcaatggaaatttctactatagtgaaaattacaaaaagtctaacaatgaggtaccctcccagcctcaggacggcgatgctaacggcgcatacaatattgcgcgtaaaggcctgatgatcattaacaagcttaagaaggcggatgatgttacaaacaatgaattactgaagatctccaagaaggagtggttggaatttgctcagaaaggagaccttggtgagtga

SEQ ID NO: 133 - DNA, 3837 bp, Artificial Sequence
  Description of Artificial Sequence: Synthetic polynucleotide
atgtctattaacattaacaaattcagcgacgaatgtcgtaaaatcgatttttttacagacctttacaacatccaaaagacgttgcgtttttcgttgatccctatcggggcaacagcggacaactttgaattcaaagggcgtctgagcaaagaaaaggatcttttggattcagcaaaacgtatcaaagaatacattagtaaatatttagcggacgaatcggacatttgtttatctcagccggttaaattgaagcacttagacgagtactatgaactgtacatcaccaaggatcgtgatgagcaaaaattcaaatctgtggaggaaaagcttcgcaaggaactggcggaccttttaaaggaaattttaaaacgcttgaacaagaagatcctttctgactacttaccggaatacttggaggacgacgaaaaagctctggaggacattgccaaccttagttcttttagtacgtactttaactcgtattacgataattgcaaaaacatgtacaccgacaaagagcagtcgactgcgatcccgtatcgttgtattaatgacaaccttccaaagttcattgataacatgaaggcttatgaaaaggctttggaggaattaaaaccatccgaccttgaggaattacgcaacaacttcaagggagtatacgatacgacagttgacgacatgttcactttagattacttcaactgtgtactgagccagtcgggcattgactcctataacgctatcattgggaacgacaaggtaaaaggcatcaacgaatacatcaaccttcataatcaaacggcggagcaaggtcacaaagtcccaaatttgaaacgtctttacaaacaaatcggctcgcagaagaagacgattagcttcctgccctcgaagttcgaatccgacaatgaattgttaaaggccgtatatgacttctacaacactggcgatgccgaaaaaaactttactgccttaaaagataccattactgagtttgaaaagatctttgataatctgtcagagtacaaccttgatggggtgttcgtacgcaacgacatttcacttactaatctgtcccagagcatgtttaacgactggagtgtatttcgcaatttatggaatgatcaatatgacaaagtcaacaacccggagaaagcaaaagacattgataaatacaatgacaaacgccacaaagtttataaaaaaagtgagtcgtttagtatcaatcagttgcaggagttaattgcaactacccttgaggaagatatcaatagcaaaaaaatcacggattacttttcatgcgatttccaccgcgtcaccaccgaagtcgagaataaataccaattggtaaaggatctgttatccagcgattacccaaaaaataaaaacttgaaaacgtccgaggaagatgtcgcgttgatcaaggactttcttgattccgtgaagtctttagagtcattcgtaaaaattttaaccggaacgggaaaggaaagcggtaaagatgaattattctatggttcctttactaaatggttcgaccaactgcgttatatcgacaaattgtatgataaggtccgtaactatattacagagaaaccatactcccttgacaaaattaaattaagttttgataatccccagtttctggggggatggcagcattccaaagagactgactactccgctcagttgttcatgaaggatgggttatattatcttggtgtcatggacaaagaaacaaaacgcgagtttaaaactcagtataatacacccgagaacgactcagacactatggttaaaatcgaatataatcaaattcctaatccagggcgcgtcattcaaaatttgatgttggtggatggtaagattgtaaagaaaaatggccgtaagaacgcggacggcgtaaatgcggtgcttgaagaactgaagaatcaatatttgcctgagaatatcaatcgcattcgtaaaaccgaatcgtataagaccacatctaataatttcaacaaagacgaccttaaggcgtacctggagtactatatcgcacgcacgaaagaatattactgtaaatataacttcgtctttaaaagcgccgacgaatacggcagttttaatgaattcgtggatgatgtcaataatcaggcttaccagatcactaaggtgaaagtgtctgagaaacaactgttatctcttgtcgagcagggtaaactgtatttattcaaaatttataacaaggacttctcggagtacagcaaaggaaaaaagaatcttcacactatgtatttccaaatgttattcgacgatcgtaacttggaaaatcttgtttacaagcttcaggggggagcagaaatgttctaccgcccagcctccattaaaaaagactcagaattcaagcatgacgccaatgttgaaatcatcaagcgtacatgcgaggataaggtaaatgacaaagacaatccaacagatgacgagaaagccaagtactatagcaagttcgactatgacatcgtgaagaataagcgctttactaaagatcagttcagtcttcaccttacccttgcaatgaactgtaatcagccagatcactattggctgaataacgatgtgcgtgagttgcttaaaaaaagtaacaaaaatcacattattgggatcgatcgtggggaacgtaacctgatctacgtgactattattaattcggatggggtaattgtagatcagattaattttaacatcatcgagaactcgtacaatggaaagaaatataaaacggactaccaaaagaagttgaatcagcgcgaagaagaccgtcaaaaggcccgtaagacctggaaaacgatcgagacgatcaaggaattaaaagacggctacattagtcaggttgtccatcagatttgtaaattaattgtccaatatgatgccatcgtcgtgatggagaacttaaacggagggttcaagcgcggccgcacgaaagtggaaaagcaagtgtatcaaaagttcgagaccatgttgattaacaaacttaactattatgttgataaaggaaccgactacaaagagtgtggtggcctgttaaaagcgtatcaacttactaacaagtttgagacctttgagcgcatcggcaaacagagcggcatcatcttttatgtagatccataccttacatctaaaatcgatccggtgacgggttttgcaaatttgctgtaccctaagtatgaaactatcccaaaaacacataacttcatctccaatatcgatgacatccgttacaaccagtcagaagattacttcgagttcgatattgactacgacaagtttcctcaaggctcgtataactaccgtaagaaatggactatctgttcgtacggaaatcgcatcaagtactataaggacagtcgcaataaaacagcctcggtagtcgtcgacatcaccgaaaaatttaaggagaccttcaccaacgcgggcatcgatttcgttaacgataatatcaaggaaaagcttcttcttgtcaactccaaggagcttttaaagtcgtttatggatacccttaaactgacagttcagcttcgcaattcggagatcaacagcgatgtggactatattattagtccgatcaaggatcgcaacggaaacttctactatagtgaaaattacaagaagtcaaacaacgaggtgcccagccaaccacaagatggagacgctaatggcgcctacaacattgcacgcaaaggcctgatgatcatcaacaaattaaaaaaggcggacgacgtgaccaataacgagctgttgaaaatttcaaaaaaggaatggttggagtttgcgcagaaaggtgatttaggtgagtga

SEQ ID NO: 134 - DNA, 3837 bp, Artificial Sequence
  Description of Artificial Sequence: Synthetic polynucleotide
atgtcgatcaatatcaataaattttctgatgagtgccgtaagatcgactttttcactgatctttataatatccaaaaaactttgcgctttagtctgattccgattggcgctacagctgataattttgagtttaaaggtcgcttatctaaggagaaggatttattggattcggcgaagcgtattaaggaatatatctctaagtatctggctgacgaatccgatatttgtttaagtcagccagtgaaacttaagcacctggacgagtattatgagttgtatattaccaaagatcgtgacgagcagaagtttaagtccgttgaggagaaactgcgtaaggaattagccgaccttttgaaagagatcctgaagcgtctgaacaaaaagattcttagcgactatttaccggagtaccttgaggatgatgagaaggccttagaagacatcgctaacttgtcctcattctctacgtactttaatagttattatgacaactgcaaaaatatgtatacagataaagagcaatcgaccgccatcccttaccgttgcatcaacgataacttaccgaagttcatcgacaatatgaaagcctatgaaaaagccttagaggagctgaagccaagcgatttggaggagcttcgtaacaattttaagggagtatacgacacgaccgtggacgacatgttcactctggactactttaactgcgtgttgagtcagtctggcatcgacagctataacgcaatcattggcaatgacaaagttaagggcatcaatgaatatattaacttgcacaatcaaactgctgagcaaggacacaaagtgcccaatcttaaacgtctttacaaacaaatcggttcacaaaagaaaacgatttcttttcttccttccaaatttgaatcggataatgaactgttgaaggccgtgtatgatttttataatacgggtgacgccgaaaaaaactttactgcattaaaagacactatcacagaatttgagaagatctttgataacttgtccgagtataacttggacggcgtattcgtacgcaacgacatttccctgacaaatctttctcaatccatgttcaacgattggtcagtatttcgtaacttgtggaacgaccagtacgataaggtgaacaatcccgaaaaagcaaaagacatcgacaagtataatgataaacgtcataaagtgtataagaaatccgagagcttctccatcaaccaactgcaagaattgattgcgaccacgctggaggaggatattaactcgaagaagatcaccgattacttctcctgtgattttcaccgtgtgacgactgaagtcgagaataaatatcagcttgtgaaagaccttttaagttcagattacccaaaaaacaaaaatctgaagaccagtgaggaagacgtggccttaatcaaagatttcttagatagcgtaaagtctctggagagcttcgtcaaaatcctgacgggcacaggcaaagaaagtgggaaggacgaacttttctacgggagttttacaaaatggttcgatcaattacgttacatcgataagctgtacgacaaagtccgtaactatatcaccgagaaaccatactcattggacaagattaaattgtccttcgacaacccacagtttttgggtggttggcagcattcaaaggagactgattatagtgcgcagctttttatgaaggatggcctttattaccttggcgtgatggataaggagaccaagcgtgagtttaagactcaatacaacactcccgagaatgactcagatacgatggtcaaaatcgaatataatcagatcccaaaccccggccgtgtaatccagaatcttatgctggtggacggtaaaatcgtcaaaaaaaacgggcgtaagaatgccgatggagtgaatgccgtacttgaagagcttaagaaccagtaccttccagaaaacatcaaccgtatccgtaagaccgagtcctacaagacaacgagcaacaacttcaacaaggatgatcttaaagcttacttggagtattatattgcccgcacgaaagagtactattgcaagtacaacttcgtatttaaatcggcagacgaatacggcagtttcaacgaatttgtggacgatgtgaataatcaggcataccagattacaaaagttaaggtttcagaaaagcaacttctgagtttggtggagcaaggaaaattgtacctgtttaagatctacaacaaggactttagtgaatattcgaagggaaagaaaaacttgcatacgatgtattttcaaatgttgtttgatgaccgtaaccttgaaaacttagtgtacaaactgcaaggaggtgcggagatgttttaccgccctgcttcaatcaaaaaagacagcgagttcaaacacgacgcaaatgtagagatcatcaagcgcacgtgcgaagacaaggtaaacgataaagataatcccacagacgacgaaaaggccaagtactattcgaaattcgattatgacatcgttaagaacaaacgttttacaaaggatcaattcagtttacacttaacgttagcaatgaattgtaatcaaccggaccattactggctgaacaacgacgtacgcgagttgctgaagaagtctaataaaaatcatatcattggtattgaccgtggtgagcgcaatctgatctatgtaacgatcattaatagtgacggagtgatcgtagatcaaattaatttcaacatcattgagaattcatacaatggtaaaaaatataagacggactatcagaaaaaactgaaccaacgcgaggaagatcgtcaaaaagcccgtaagacgtggaaaacaatcgaaaccattaaggaattgaaagacgggtatatctcccaagtagttcaccaaatctgcaagcttatcgtccaatatgatgcgatcgttgtcatggaaaatttgaatggtgggtttaagcgcggccgcaccaaagtggagaagcaagtttatcaaaaattcgaaacaatgttgatcaataagttgaattattatgtcgataagggcaccgattacaaagagtgcggtgggttattaaaggcataccagctgaccaacaaatttgagacttttgagcgcatcgggaaacaatctggcatcatcttctacgttgatccgtatttaacttccaaaattgatcccgtgaccggctttgcgaacctgctttatcctaagtatgagacgatccccaagacacataatttcatcagcaacatcgatgacattcgttacaatcaatcagaagactactttgaattcgatatcgactatgataaattcccacagggttcttataactatcgtaagaaatggaccatctgttcatatggcaatcgtattaaatattataaagattctcgcaacaaaaccgcctctgtcgtagtcgatatcaccgagaagttcaaggaaactttcacgaacgctggaattgacttcgtcaacgacaacatcaaagaaaaacttctgttagtaaattcaaaagagttactgaaaagctttatggacacgcttaagttgaccgttcagttgcgtaattctgaaattaactcggacgttgactatatcatcagtccaatcaaagaccgtaacggaaacttctactactcagaaaactacaagaaaagcaataacgaggtgccctcgcaaccacaggatggcgatgctaacggcgcttataatattgcgcgtaaggggttgatgattatcaataagctgaagaaggcagatgatgtgacaaacaatgagcttcttaaaattagcaaaaaggaatggttggagtttgcccagaaaggagatcttggcgagtga

SEQ ID NO: 135 - DNA, 4689 bp, Leptospira sp.
atgaaagcaacatccatttgggacaactttactcgtaaatattccgtatctaaaacacttcggtttgaattgaggccagtggggaagacggaagagaatattgtgaaaaaggaaattattgatgcagagtggatcagcggaaagaatattccgaagggaactgatgctgaccgggcaagagattataaaattgttaaaaaattactgaatcaactccatattttatttattaatcaggcattatcctctgaaaatgtgaaagagttcgaaaaagaggataaaaagagtaaaacattcgttgcatggagtgatttacttgcaactcattttgacaactggattcaatatactcgtgataaaagtaattccactgtcttaaaatccttagagaaatcgaaaaaggacctatattcaaaacttgggaaactactcaactctaaagccaatgcctggaaggcagagtttataagttatcacaaaattaaaagcccggacaatataaagattagattgtctgcaagcaatgttcagatactatttggaaatacatcggatcccattcaattattgaaatatcagattgagttagataatataaaatttctaaaggatgatggatccgaatatactacaaaagaattagccgacttgctttctacgtttgaaaaatttggaacttatttttctggattcaatcaaaatcgagcaaatgtctatgacattgatggcgagatttctacctcaattgcatatagactttttaatcaaaatatagaattctttttccaaaacattaaaagatgggagcaattcactagttctattggtcataaagaagcaaaggaaaatctaaaattagtccaatgggatattcaatcaaaactcaaagaattagatatggaaatagttcaaccaagatttaatcttaaatttgaaaaattactcactccacaatcgttcatttatctactcaaccaagaaggcattgatgcattcaacactgtccttggtggaattcccgcagaagtgaaagctgagaaaaagcagggagtaaacgaactaatcaatttaactcgacagaaattaaatgaagacaagagaaaattcccttctcttcagattatgtataaacagatcatgagtgaaagaaaaacaaacttcattgatcagtatgaagatgatgtagaaatgttaaaggaaatccaagaatttagtaatgactggaatgaaaaaaagaaaaggcattcagcatcaagtaaagagatcaaagaaagtgcaattgcctatattcaaagagagtttcatgaaacattcgattcattggaagaacgcgctaccgtaaaagaagatttctatctgagtgaaaagtcaattcagaatctatcaattgatatttttggaggttataataccatccacaatctttggtatacagaagtagagggaatgttaaaatccggcgaacgaccactcactagagtagaaaaagaaaaactcaaaaaacaagagtatatttctttcgctcaaatcgaaaggcttatctcaaagcattcacaacaatatctagattcaacgccaaaagaggccaatgatagatctcttttcaaagagaagtggaaaaaaacgtttaaaaatggatttaaggtatcagaatatacaaatttaaaattgaatgagctaatatctgaaggtgaaacatttcaaaagattgatcaagaaactgggaaagaaaccacaattaaaattcctggtttatttgaaagttacgaaaatgcaatattagtcgaatccataaaaaatcaatcgcttggaacaaataaaaaagagtctgttccgtccattaaagaatatcttgattcctgtttgagattatctaaattcattgaatcatttttagtcaattcaaaggatctaaaagaagatcaatccttagatggttgcagcgactttcagaatacgcttacacaatggctcaatgaggaatttgatgttttcattttgtacaacaaggtaagaaaccatgtaaccaaaaaaccaggaaatactgataagataaaaataaacttcgacaacgctacgttattagatggttgggatgtagataaggaagcagcaaacttcggatttctacttaagaaggcggataactactatctaggaatagctgattccagctttaatcaagacttaaagtattttaacgaaggagagagattggatgaaattgaaaaaaacagaaagaatcttgaaaaagaagagagtaaaaacatttcgaaaatcgaccaggaaaaagtaaaaaaatataaggaagtaattgatgacttaaaagcaatttccaatcttaataaaggacgttattcgaaagcattttataaacaaagcaaatttactactttaataccaaaatgcaccacacagctaaatgaagtgatagagcattttaagaaattcgacactgattatagaattgaaaataaaaaatttgcaaaaccttttataatcacaaaagaagtctttttacttaataatacagtttatgatacagccaccaaaaagtttactcttaaaataggtgaggatgaagatacaaaaggattaaaaaaatttcaaatcggatattatcgtgcgacagatgacaaaaaaggatatgagtccgccttacgaaactggataactttttgtattgagtttacgaaaagttataaaagttgccttaactataattactcatccttaaaatctgtgtccgaatacaagtcactagatgaattctataaagatttaaatggaatagggtatacgattgatttcgtagacatttccgaagaatacataaataaaaaaataaatgaaggaaaactatatcttttccaaatctacaataaagatttttcagaaaaatcaaaaggaaaagaaaacctccatacgacctattggaagttgttatttgattcgaaaaaccttgaagatgtagttataaaactaaacggacaagcggaagtgttctttcgaccagcttctattcatgaaaaagaaaaaatcactcatttcaaaaatcaggaaatacaaaataagaatcctaatgctgtgaaaaaaactagtaaatttgaatatgatataatcaaagacaatcgatttacgaaaaacaaattcttgtttcattgccctatcacattgaattttaaggcagatggaaatccgtatgtaaataacgaagttcaagaaaatatagcaaaaaatccaaatgtgaacatcattggaatcgaccgtggagaaaaacatctcctttattttacagttatcaatcagcaagggcaaatactcgatgctggtagtctgaattccattaaatccgaatataaagataaaaaccaacaatcagtctcctttgagacaccgtaccacaaaatcttagataaaaaagagtcagaaagaaaagaggcaagggaatcttggcaagaaattgaaaatatcaaagaactaaaagcaggatatttgtcacacgtagtacaccaattatcaaatttgatcgttaaatacaatgcgatagtggtactcgaagatttaaataagggatttaaaagaggtagatttaaagttgaaaaacaagtttatcaaaaatttgaaaagtcgttgatagaaaagttgaattatctggttttcaaagaccgcaaagaatcaaatgaacctgggcatcatttgaatgcttatcaattaacaaataaattcttaagctttgaaagattaggtaaacagtcaggagtccttttttatgcaactgcgagttatacatcaaaagtggatcctgtcactggctttatgcaaaatatttatgatccatatcataaagaaaaaacaagggaattctataagaattttaccaagattgtttataatggaaactactttgaatttaattatgatttgaactcagtaaagcctgattctgaagaaaaaagatatcggacaaattggacagtatgcagttgtgtgattcgatctgagtatgattcaaattccaaaactcaaaaaacttataatgtaaatgatcaacttgtaaaactattcgaggatgccaaaataaaaattgagaacggaaacgatctaaaatccaccattctagaacaagatgataaatttatccgagacctccatttttactttattgcaatacagaagatgagagttgttgattcaaaaatagaaaaaggagaagattcgaatgattatattcaatcgcccgtttatcctttctattgttccaaagaaattcaaccgaacaaaaaaggattctatgaacttccaagcaatggagattccaatggagcctacaatatcgcgcggaaaggaattgtaattttggataagattcgtttgagagttcaaatcgaaaaattgtttgaagatggaacgaaaattgattggcaaaaacttccaaaccttatttcaaaagtaaaagataaaaaacttctcatgactgtctttgaagaatgggcagaactgacacatcaaggggaagttcagcaaggtgacttgcttgggaaaaagatgagtaagaaaggagaacaatttgctgaatttataaaaggactcaatgttacaaaggaagattgggaaatttatactcaaaatgaaaaagtagtacaaaagcagataaagacttggaaattgtttagcaattctacctaa

SEQ ID NO: 136 - DNA, 4689 bp, Artificial Sequence
  Description of Artificial Sequence: Synthetic polynucleotide
atgaaggcgactagtatttgggataactttactcgtaagtatagtgtatctaaaacgcttcgctttgagcttcgccctgttggtaagactgaggaaaatattgtaaaaaaggagattattgacgccgagtggattagcgggaagaacattccaaagggtactgatgctgaccgcgcgcgcgactataaaattgtcaaaaaattgttaaaccagctgcacattcttttcatcaatcaggccttgtcttcggagaatgtaaaggaattcgagaaggaggacaaaaagtctaaaacctttgtggcttggtcggatctgttggcgacgcacttcgataactggatccaatacacacgtgataagtctaatagcactgtcttaaaatctttagagaagtcaaaaaaagatttatactcgaagttaggaaaattactgaactcaaaggctaacgcttggaaagcagagtttattagctaccataagattaaaagccccgacaatatcaagattcgcttatctgcgagcaacgttcaaatcctgtttgggaatacgagtgatccaatccaactgttaaaataccaaatcgaactggataatattaagttcctgaaagatgatggctcggaatatacaacgaaagaactggctgatctgttgagtacctttgaaaaattcgggacgtacttttccggctttaaccagaatcgtgcaaacgtgtatgatattgatggtgaaatttcaacgagtatcgcttatcgtctttttaaccagaatatcgaattttttttccaaaacattaaacgttgggagcagtttacaagttcaatcgggcacaaagaggccaaggaaaacctgaagcttgtgcagtgggatattcaatccaagctgaaagagcttgacatggagatcgtgcaacctcgctttaaccttaagtttgaaaagcttctgacaccacaaagtttcatttacttgctgaaccaagagggaattgatgcgtttaacaccgtcttaggcggaatcccagctgaggtgaaagctgagaaaaaacaaggcgtaaacgaactgatcaaccttacacgccaaaaattaaacgaggacaaacgcaaatttccctctctgcaaatcatgtataaacagattatgagtgagcgtaaaacgaatttcattgaccagtatgaagatgacgtggaaatgttaaaggagatccaagagttctcaaatgattggaacgaaaagaagaagcgtcattctgcatctagtaaggagatcaaggagagtgcaattgcgtacattcagcgcgaattccatgagacttttgacagtttggaagagcgcgccacagtcaaagaggacttctatttgagcgaaaagtctattcagaatttgtcgatcgacatcttcggcggctacaacacaattcacaatttatggtacactgaagtagaggggatgctgaagtcaggtgaacgtcctttaactcgtgtagaaaaagaaaaactgaagaagcaggaatatatctcatttgctcaaatcgagcgccttatttccaagcacagtcagcagtatcttgactcaacacctaaagaggctaacgaccgttcattgtttaaggaaaaatggaaaaaaactttcaagaatggcttcaaggtatcagaatacacaaatttgaagcttaacgaactgatctcggagggagaaacattccagaaaattgatcaagaaacaggcaaggaaacaacaatcaagatccccggtttgttcgagtcttatgagaatgccatcttggttgaatctatcaagaatcaaagtttaggaaccaataagaaagagagcgtgccgtcgatcaaggaatatttagatagctgccttcgcttatctaagttcatcgagagcttcttggtgaacagcaaggatttaaaagaggatcaaagcctggatggatgcagcgactttcaaaacactttgactcaatggcttaatgaagagtttgacgtttttatcctgtataataaggtccgtaaccatgtaaccaagaaaccgggcaatacagacaaaattaaaattaacttcgataacgccacgctgcttgacggttgggacgtagataaagaagccgcaaactttggtttcttactgaaaaaggcagataactactatttagggatcgctgattcatcgtttaaccaggatcttaagtattttaacgagggagaacgcttggatgaaatcgaaaaaaaccgcaaaaatttggagaaagaagaatccaaaaatatcagcaaaattgaccaggagaaagttaaaaaatacaaggaggtcattgacgatttgaaggccatttcgaaccttaataaaggacgttactctaaagctttttataaacagtcaaaatttacaacgcttattcccaagtgtacaacccaattgaacgaagtcattgaacacttcaaaaaattcgatacggactatcgtattgagaataaaaagtttgctaaaccctttattattacgaaagaggtttttttgttaaataatacggtgtacgatactgctacgaaaaagttcacgcttaaaatcggggaagacgaggatacgaaaggactgaaaaagtttcagattggctactaccgcgcaacagacgacaagaagggttatgaaagcgccctgcgtaactggattaccttttgtatcgagtttacaaagagctacaagtcgtgtttaaactacaactattcgtcgcttaaatcagtaagtgaatacaagtcgcttgatgaattttacaaggatttaaacggtattgggtatactattgactttgtcgatatctctgaggagtatatcaataagaagatcaacgagggtaagttatatttattccaaatctataacaaagatttcagcgaaaagtcaaaagggaaagagaatctgcacacaacgtattggaaactgttattcgactcaaagaacttggaggatgttgttatcaagttgaacgggcaagctgaagtctttttccgtcccgccagtatccacgaaaaggaaaagatcacgcacttcaaaaaccaggaaattcaaaataagaaccccaacgccgtgaaaaaaacgtccaaattcgagtacgatattattaaagacaaccgcttcacaaaaaacaagttcttgttccattgcccaatcactctgaattttaaagccgacgggaacccgtacgtgaataacgaggtacaggaaaacattgccaagaatcctaatgtaaacattatcgggatcgaccgtggggagaagcatttgttgtactttacggtaatcaaccaacaaggacagatcctggatgcgggcagcctgaactcaatcaagtccgaatataaagataagaaccaacagtccgtctctttcgaaacgccgtaccacaaaatcctggacaaaaaggagagtgagcgtaaggaggcccgcgagagctggcaagagattgaaaacatcaaggaactgaaagccggataccttagccatgtcgttcatcaactgagcaacttgatcgtaaagtacaatgcaatcgtagttctggaggatttaaataagggctttaagcgcgggcgcttcaaagtagagaagcaagtctaccaaaagttcgagaagtctttgattgagaagttaaattatttagtctttaaggaccgtaaggaatcaaatgagcctggtcaccacttgaacgcttaccaactgacaaacaaattcttgtcttttgagcgccttgggaaacaaagtggtgtacttttctacgctacagcgtcatacacctcaaaggtcgaccccgtaacgggatttatgcaaaatatttatgatccatatcataaggaaaaaactcgcgagttctataaaaacttcacgaagatcgtctataacgggaactattttgagtttaattatgacttgaactcagtcaagcctgacagcgaggagaagcgttaccgcacaaattggacggtatgctcctgtgtgattcgttcggaatacgactctaattcaaaaacgcaaaagacatataatgttaatgaccagctggttaaattatttgaagacgccaaaatcaaaattgagaacggtaatgatttaaagtcgacaatcttagagcaggatgataagtttatccgcgatttacacttctacttcatcgcaatccagaagatgcgtgtcgttgatagtaaaatcgaaaaaggcgaagattcaaatgattatattcagagcccggtttaccccttctactgctccaaagaaatccagccgaacaaaaagggcttctacgagttaccatcaaacggtgattctaacggagcgtacaacattgctcgtaaaggcatcgtaattttagacaagatccgcctgcgcgtacagattgaaaagttattcgaggacgggacgaaaattgattggcagaagcttcctaatttaatctctaaggttaaggacaaaaagcttttgatgacggtgttcgaagagtgggcggagcttacacatcaaggagaagttcagcaaggtgaccttcttggtaagaaaatgtcgaaaaagggagaacagttcgcggagtttattaaaggattgaatgtaacgaaggaagactgggaaatctacacgcaaaacgagaaggtagtacagaagcaaattaagacttggaagcttttttcaaactcgacctaa

SEQ ID NO: 137 - DNA, 4689 bp, Artificial Sequence
  Description of Artificial Sequence: Synthetic polynucleotide
atgaaggcgacgtcgatttgggacaacttcacacgtaaatacagcgtctctaagacacttcgtttcgagctgcgcccagttggaaaaactgaagagaatatcgttaaaaaagaaattatcgacgcggagtggatctcaggcaaaaatattccaaaaggtactgatgcagatcgcgcccgtgactataaaatcgttaaaaagttattaaatcaactgcatatcttattcatcaaccaggctttatcgagtgaaaacgttaaggaatttgagaaagaggataagaaaagtaagacgtttgtcgcatggtctgatttgttagctacgcatttcgataattggatccagtatacgcgcgataagtcaaactcgactgtattgaaatcattggagaaatcgaaaaaggatttgtacagtaagttgggtaaactgttgaatagtaaagcaaacgcgtggaaagctgaatttattagttatcataaaattaagtctccagacaatattaaaattcgtctttctgcatccaatgtgcagatcctgtttggtaacaccagtgatccaattcagttgcttaagtatcagatcgaacttgacaacattaagtttctgaaagatgatggaagtgaatacaccacaaaagagcttgcagacttactgtcgacattcgagaagttcgggacgtatttttcaggatttaaccaaaaccgtgccaacgtctatgacattgatggggaaatctccactagtatcgcctatcgcctgtttaaccagaatattgagttcttttttcaaaatatcaagcgttgggagcagttcacatccagtatcggtcataaagaggcgaaggagaacctgaaactggtacagtgggatatccaaagcaaattaaaggagcttgacatggaaatcgtccagccccgtttcaatttaaagtttgagaagttgctgactccgcaaagtttcatctatttattgaatcaagagggaattgatgcttttaacacagtccttggcgggattccagcagaagtgaaagcggaaaaaaaacagggggtcaatgaattaattaacttgacccgtcagaagcttaatgaagataaacgcaagttcccttcattacaaattatgtacaaacagattatgtcagaacgcaaaacgaatttcatcgaccaatatgaagatgacgtcgagatgttgaaagagatccaggagttcagtaacgattggaacgaaaaaaaaaagcgtcacagtgcatcatccaaagagattaaggaatccgcgattgcttatattcaacgcgagttccacgaaacattcgactccttagaagagcgcgcaacagtcaaagaggatttttatcttagcgaaaaatcaattcaaaacttaagtatcgacatcttcggagggtataatactattcacaatttgtggtacactgaggtggaggggatgttaaaatcgggagagcgccctttgactcgtgtggagaaggagaagttaaagaaacaagaatatattagcttcgctcagattgagcgtttaatcagtaagcacagtcaacaatatctggacagtaccccgaaagaggccaatgatcgttcgctttttaaagagaagtggaaaaagacatttaaaaatgggtttaaggtcagcgaatataccaatcttaagctgaacgagttaatctccgaaggggagacattccagaagatcgaccaagagacgggcaaagaaaccacaattaagatcccgggcttatttgagtcatatgaaaacgcgattttagtcgagtcaattaagaatcagtctctgggcacgaataaaaaggagagtgtacccagtattaaggaatacttagactcgtgcctgcgcttaagtaagtttattgagtcgttcttggtcaactcgaaggatctgaaggaagatcaaagtttggatggctgttctgactttcagaacacattaacacaatggcttaatgaggaatttgatgtcttcattctgtataacaaggtacgtaaccatgtgaccaagaagccgggtaatacagataaaattaagatcaactttgataacgccacgctgctggacgggtgggacgtggacaaagaggcggccaacttcggatttttgttaaagaaggcggacaattactacttggggattgctgattcctcgtttaaccaggatttaaaatactttaacgaaggagaacgcctggacgaaattgaaaagaaccgtaagaacctggaaaaagaagaatctaagaatattagtaagatcgaccaggagaaggtgaagaagtataaggaagttattgatgacttgaaagctatttccaatttgaacaaaggacgttactcgaaagccttttacaagcagagcaagtttactacgttaattccgaaatgcacaacccagcttaatgaagtcattgagcactttaaaaagttcgatacagattatcgcattgaaaataagaagtttgctaagccattcattattactaaagaggtttttcttctgaataacactgtgtatgacaccgcaacaaaaaaatttaccttaaagattggggaagatgaagacacaaaggggttgaagaaattccagattggatactatcgcgcaaccgatgataagaaggggtacgaatcggcgctgcgtaactggatcacattctgcatcgaattcactaagagttacaaatcgtgccttaattacaactacagtagtcttaagagtgtttcagagtacaaatctttagacgaattctacaaagacttgaatgggatcggttacactattgacttcgttgatatctcagaagagtacattaataaaaaaatcaacgagggcaagctgtatctttttcagatctacaataaagatttttccgaaaaaagcaaagggaaggaaaatttacatacgacttactggaagctgttatttgactcgaagaatttggaggatgttgttatcaaacttaacggacaagcagaagtcttcttccgtccggcgtcaattcacgagaaagaaaagattacgcactttaagaatcaggaaatccaaaacaagaatccaaacgccgtgaagaagaccagtaagtttgaatatgatattattaaggacaatcgctttacaaagaataaatttctttttcactgtccgattactctgaactttaaagcagacggcaacccttatgtgaacaacgaggttcaagagaatatcgctaaaaatcccaatgtgaacatcatcgggatcgaccgtggcgagaaacaccttctttactttactgtaatcaatcaacaaggccaaattttagacgctggctcattaaatagtattaaaagtgagtataaggacaaaaaccagcagtcggtttcctttgagactccgtatcacaaaattttagacaaaaaggaatccgagcgtaaggaagctcgcgaatcttggcaggagattgaaaatattaaggagttaaaggcaggatatttgtcgcatgtcgtccaccaattgtcaaatctgatcgttaagtacaacgcgattgtcgttttagaagacctgaataagggcttcaaacgtggacgttttaaggtggaaaaacaggtatatcaaaagttcgagaaatcattaatcgaaaagctgaattatttagtctttaaggaccgcaaggagagcaacgagccgggtcatcatttaaacgcttatcagctgacgaataagttcctgtcgtttgagcgtttagggaagcaaagcggcgtattgttttatgctactgcttcatatacatctaaagtagatcccgtaaccggattcatgcagaatatttacgacccatatcacaaggagaaaactcgcgaattttacaagaattttactaaaattgtgtacaacggcaactatttcgagttcaattacgatcttaacagtgttaaaccggattcagaagagaaacgttatcgcactaattggacggtttgcagttgcgttattcgtagtgaatacgactcaaatagtaagacacagaaaacgtataacgtgaacgatcaattggtcaaactgtttgaggacgcgaaaattaagatcgagaatggtaatgaccttaagtctacaatccttgaacaggatgacaagtttatccgcgatttacatttctattttatcgccatccaaaaaatgcgcgtggttgacagcaagattgagaaaggtgaagacagcaatgattacatccagtcgccggtctatccattttattgctccaaggaaatccaacccaataaaaagggcttctatgaacttccctcgaatggagactccaatggagcttacaacatcgcacgcaaggggattgtgattcttgacaagattcgtttgcgcgtacaaattgaaaaattgttcgaagatggtacgaaaattgactggcagaagcttcctaacttaatttcgaaggtcaaggataagaagttacttatgaccgtcttcgaggagtgggccgagcttacccaccagggagaagtacaacagggagacttgttgggaaaaaaaatgtcgaaaaaaggcgaacagttcgcagaatttatcaaggggttgaatgttactaaagaagactgggaaatttacactcagaacgagaaagtcgttcagaaacaaattaagacatggaagcttttctctaactcgacctaa

SEQ ID NO: 138 - DNA, 4689 bp, Artificial Sequence
  Description of Artificial Sequence: Synthetic polynucleotide
atgaaggcaacgtccatctgggacaatttcacccgtaaatattcggtgtctaagactctgcgtttcgagctgcgcccggttggcaagacggaggaaaacattgtaaagaaggaaattattgacgccgaatggatctctgggaaaaatatcccgaagggtaccgacgccgaccgcgctcgtgattataaaattgtgaagaagttgttgaatcaattgcatattttgttcatcaatcaggcactgtcgagcgagaacgtaaaggaattcgaaaaggaagataaaaaatcaaagacttttgttgcgtggtcagatctgttggcgacccatttcgacaattggattcaatatacccgtgataaatctaactccaccgtattaaaatccctggaaaagtctaagaaggatctttactccaagttgggaaagcttttgaattctaaggctaatgcgtggaaagcagaattcatttcgtatcataagattaaaagccctgataacattaaaattcgtctgtcggcgtcaaatgtacagattttgtttggaaataccagcgacccaattcagttattaaagtaccagatcgagttagacaatatcaaatttttgaaggacgacggcagcgaatacactactaaagagttagcggacctgctgtcaactttcgaaaagttcggtacttacttttccggttttaatcaaaaccgtgctaacgtttatgacattgacggagagatcagtacctcgatcgcttatcgtctgttcaaccagaatatcgagttttttttccagaacattaagcgctgggaacagttcacatcctcaattggccacaaggaagctaaggagaaccttaaattggtccaatgggacatccagtctaagttgaaagaattagatatggaaatcgtacagcctcgcttcaatttgaaattcgagaagcttttgactccacagtcgttcatttacttattgaatcaggaaggcatcgacgcatttaatacggtcttggggggcatccccgctgaggtgaaagcggagaagaagcagggggtaaacgaattgattaatttaacccgtcagaaattgaacgaggacaaacgcaaatttccctccttacaaattatgtacaagcaaattatgtctgaacgtaagacaaattttatcgatcagtatgaggatgatgtcgaaatgctgaaggagatccaagagtttagcaacgattggaatgagaaaaaaaagcgccattccgcttcgagcaaagaaattaaggaaagtgccattgcctacatccaacgcgaattccatgaaacttttgactcattagaagaacgcgctacagtaaaagaagacttttatctgagtgaaaaaagtatccaaaatttatctattgacatcttcggcggctataacacgatccacaatttgtggtatactgaagtcgaaggcatgcttaagagtggtgagcgcccgttgacacgtgtagaaaaggaaaaattgaaaaagcaagaatacatcagtttcgcccaaattgagcgtttaatctcgaaacattcacagcagtatttagattccactcctaaggaggcaaatgatcgttcccttttcaaggagaaatggaaaaagacattcaagaacggattcaaggtctctgaatacaccaaccttaaattgaacgaactgatctcggagggcgaaacctttcaaaagatcgatcaggaaaccggtaaggagaccacaattaagattcccgggttgttcgagtcatacgagaacgctattctggttgagtctatcaagaatcaaagcttgggcacgaacaaaaaggaatcggtaccatcgattaaagaatatctggacagttgtttgcgtttatcgaagttcattgagtctttccttgtgaattcaaaggacttgaaagaagatcaatcgttggacggatgttctgactttcagaatacgttaacccagtggttaaatgaggaatttgatgtttttatcttatataataaggtccgtaatcatgttaccaaaaagcctggaaataccgataagatcaaaatcaatttcgataacgccacattgcttgacggttgggatgtagataaagaggcggcaaacttcgggttcctgcttaaaaaggcggacaactattaccttggcattgccgacagtagctttaatcaggatttgaagtatttcaacgaaggtgaacgcctggatgaaatcgagaagaaccgtaaaaatttggagaaggaggaaagcaagaatatctcaaaaattgaccaagaaaaagttaagaagtataaggaagtaattgatgaccttaaggcaatcagcaaccttaacaaagggcgctactcgaaggctttttacaagcagtccaagtttaccactctgatcccgaaatgtaccactcaattaaacgaagtcattgagcatttcaaaaaatttgacaccgactatcgcattgagaataaaaagttcgcgaaaccattcatcattaccaaggaggtttttttattaaataacaccgtgtacgataccgcaacgaaaaaatttacgttgaaaatcggggaagatgaggacacgaagggcttaaaaaaattccagattgggtattaccgcgccactgatgacaaaaaggggtacgagtcggccttgcgcaactggattacattttgtatcgagttcacaaaaagttataaatcatgccttaactacaattattcatcgttaaaaagcgtctccgagtacaaatctcttgacgagttctataaggaccttaatgggatcgggtatacaatcgactttgtagacatttcagaggaatacatcaataagaaaatcaatgagggcaagttatacctttttcaaatctataacaaagactttagtgagaaatcaaaaggcaaagaaaatctgcataccacgtattggaaacttcttttcgacagcaagaacttggaagacgttgtaatcaaacttaacgggcaggccgaagtatttttccgtccagcatcgattcatgagaaagaaaaaatcactcattttaaaaaccaagaaattcagaacaagaatccgaatgccgtgaaaaaaacttccaagttcgaatacgatatcatcaaggacaaccgttttactaaaaataaattcttgttccattgtcctattacgctgaactttaaggctgacggtaatccttatgtaaataacgaagtacaagaaaacatcgctaagaatcccaatgtaaacattatcggtattgatcgcggagagaagcatctgctttacttcacagtcatcaaccagcaaggccagatcttagacgcaggttcgttgaacagcatcaagtccgagtacaaggataaaaatcagcaaagtgtctcgtttgaaacgccctatcacaagattcttgacaagaaggaatcagaacgtaaggaagcccgcgagtcgtggcaagaaattgagaatatcaaggagcttaaagcgggatatctgtcgcacgtcgttcatcaactttctaatttaatcgtaaagtacaacgcgattgtagtgttagaagacctgaacaagggatttaaacgcggacgcttcaaagtagaaaagcaagtctatcaaaaatttgaaaagtccctgattgaaaaattgaattatttagtattcaaggaccgcaaggagtctaatgagcctggtcaccaccttaacgcttatcaattgactaacaaattcttatcattcgaacgtttaggtaagcaatcaggcgtgttgttttatgctaccgctagttacacatcaaaggttgatccggtgaccggcttcatgcaaaatatctatgacccgtatcacaaagaaaaaactcgcgagttctacaagaacttcacgaagatcgtttacaatggaaactatttcgaatttaattatgacttaaactctgtaaaacccgactccgaagaaaagcgttatcgtacgaattggaccgtttgctcctgcgttattcgctcagaatatgatagcaatagtaaaacacagaagacatataatgtaaatgaccagcttgtgaaactgtttgaagatgctaaaatcaaaatcgaaaatggtaacgacttgaagtctacgattcttgagcaagacgacaagtttattcgcgatctgcacttttattttattgctatccagaaaatgcgcgtggtggacagtaaaatcgagaaaggggaagactcaaacgactatattcagtcaccagtctatcccttctactgcagcaaagagatccaaccaaacaagaagggtttctacgaattaccaagtaacggtgactctaacggcgcatacaacatcgcacgcaaagggattgttattctggataaaattcgcctgcgtgtacaaattgaaaagttatttgaagatgggaccaaaatcgactggcaaaagttgcctaaccttatcagcaaagtgaaagacaagaaactgttaatgaccgttttcgaagaatgggcggagttaactcatcagggagaggtacaacaaggagacttgctgggcaagaaaatgagcaaaaaaggggaacagtttgcagagtttattaagggccttaacgttacgaaggaagattgggaaatttacacccagaatgaaaaggttgtgcaaaagcagatcaagacttggaaattgttttctaactccacttaa

SEQ ID NO: 139 - DNA, 2616 bp, Prevotella sp.
attaaggctattaatgaatattataagcagttgggagcttattgtcgtgaagaaggaaaagaaaaagatgatttctttaagcgtattgatggtgcttattgtgctatatcacatcttttctttggggaacatggcgaaatagcccagtcagactcagatgttgagcttatccaaaagttgctcgaagcctataaggggttacaacgctttatcaagcctttattaggtcatggtgatgaagctgataaagacaatgagtttgatgcaaaacttcgtaaagtatgggatgaactcgacatcattacaccgctttatgataaagtacgcaattggctctctcgtaagatatataaccctgagaaaataaagctatgttttgagaataatggcaagttgttatctggatgggttgacagcagaactaaatccgataatggtactcaatatggagggtatatctttagaaagaagaatgaaattggtgaatacgatttctatttgggtatttctgctgatacaaaactgtttcgtcgtgatgctgccatcagttatgatgatggcatgtacgagagattagattattatcagctgaaatcaaaaactttactcggaaatagttatgttggagattatggactggattcgatgaatttgctttctgcatttaaaaatgctgcagttaagttccaatttgaaaaggaagtggttcctaaagataaagagaatgtgccaaaatatctcaagcgcctaaaactggattatgcaggattttatcaaattttgatgaatgatgataaggttgttgatgcttacaagattatgaagcagcatattcttgcgacattgacttcttcgattcgtgtacctgcggcaatagagttagctactcaaaaagaattgggtattgacgaattgattgatgaaataatgaatttaccgtccaagtcattcggctatttccctattgtcactgcagcaatagaagaagctaacaagagagagaataaacctttgtttctttttaagatgagtaacaaggatctttcttatgcagcaacagcttctaaagggttaagaaaaggtcgaggaacagagaatcttcattcaatgtatctcaaagctcttctggggatgacacagagtgtttttgatatcggaagtggaatggtattctttcgtcaccaaactaaaggtttggcagaaacaacggcaagacataaagctaatgagtttgttgctaataagaacaagcttaatgacaagaaaaagagtatttttggctatgagatagtgaagaataaacgttttacggtagataagtacctttttaagttgtctatgaatttgaattattcgcaaccaaataacaataaaattgatgtaaattctaaagttcgtgaaataattagtaatggaggtataaagaatattattggcatagatcgtggtgaacgtaatttactttatctgtctttaatagatctgaagggaaatattgtcatgcagaagtctctcaatattctcaaggatgatcataatgcaaaggaaactgattataaaggtttgctgacagaacgagaaggagaaaataaagaagctcgccgcaattggaagaagatagcgaatatcaaagatttaaaacgaggttatttaagtcaggtagtacatatcattagtaaaatgatggtagaatacaatgcaattgttgtacttgaagatttaaatccaggttttatcagaggcagacaaaaaatcgagcgtaacgtatatgaacaattcgaaagaatgctaattgacaagttgaatttttatgttgacaagcataaaggtgccaatgaaacgggaggtttgttgcatgcacttcagcttacttctgaatttaaaaatttcaagaaaagtgagcatcagaatgggtgtcttttctatattcctgcatggaatactagcaaaatagatcctgcaacaggttttgtcaatctctttaatacgaaatatacgaatgcagttgaggcgcaggagttctttagtaaatttgacgagattcgttacaacgaggagaaagattggtttgagtttgaatttgattacgataaattcactcagaaggcgcatggtacacgtactaagtggacgctctgtacttatggtatgcgtttgcgttcatttaaaaattctgcaaaacaatataattgggattcagaggtagtagcgcttaccgaagaattcaaaagaatacttggagaagcaggtattgatattcatgagaatctaaaagatgcaatctgtaatttggaaggtaaaagccagaagtatctcgaacctttgatgcagtttatgaaattgctgctacaattgcgtaatagtaaggctggtactgacgaagattatatcctttctccagttgctgatgagaatggaatattctacgatagccgttcttgtggtgatcaacttccggagaatgcggatgctaatggtgcttacaacatcgctcgcaagggactgatgctgattgagcaaatcaagaatgcagaggatttgaataacgtcaagtttgatatatccaataaggcttggctcaattttgcacaacaaaagccatataagaatggatga

SEQ ID NO: 140 - DNA, 2616 bp, Artificial Sequence
  Description of Artificial Sequence: Synthetic polynucleotide
attaaggcgattaacgaatattacaagcagttaggagcatattgccgtgaagaagggaaagagaaggacgatttctttaaacgcattgacggcgcgtattgtgctatctcccatttgtttttcggtgaacatggagagatcgcccagtcagactcggacgtggagctgatccaaaagcttctggaagcttacaaaggtctgcaacgcttcattaaaccattgttaggtcacggagacgaagcagacaaagacaatgagtttgatgccaagctgcgtaaggtctgggacgaattagacattatcaccccgttgtatgacaaggtacgtaactggctttcgcgcaaaatttacaaccccgaaaaaatcaaattgtgctttgagaataatgggaaactgcttagtggttgggtagacagccgcacgaaatctgataacggcacacagtacgggggatacattttccgcaagaagaatgaaattggcgagtatgacttttatctgggaatttcagcagatacgaagcttttccgccgtgatgccgcgatttcatacgatgatggaatgtacgagcgtttagattactaccaactgaagagcaagacattactgggcaactcgtacgtcggggattacgggctggacagcatgaacttgttgtccgcttttaagaacgcagcggtgaagttccagttcgaaaaggaggttgtaccgaaagataaagagaatgtgccgaaatatctgaagcgtcttaagttagattatgcggggttttaccagattctgatgaatgacgacaaagtagtcgatgcgtacaagattatgaaacaacacatcctggcaaccttgacatccagtattcgtgtccctgcagcaattgagttagctactcagaaagaattgggcattgatgaactgatcgatgagatcatgaatttaccatccaagagttttggatatttcccaattgtgacagcagcaatcgaggaggctaacaaacgtgagaacaagcctttattccttttcaagatgagcaataaagacctttcatatgccgcaaccgccagcaagggcttacgtaaggggcgcggtacagagaaccttcattcaatgtatttgaaggcccttttgggtatgacccagagcgtatttgatattgggtcgggcatggtcttttttcgtcatcagacgaagggcctggccgaaacgacggcgcgccacaaggctaatgaattcgtggccaacaagaataaactgaacgataaaaagaagtccatctttggctacgaaattgtgaaaaataagcgcttcactgtggataagtatttatttaaactgtcaatgaacttgaactattcacaaccgaacaataataagattgatgtaaattcgaaagtgcgcgaaattatttctaacgggggcatcaagaatattattgggattgatcgtggcgaacgcaatctgttgtacttgtcccttatcgatcttaaaggcaacatcgtcatgcagaagtcccttaacattttaaaagatgatcataatgctaaggagacagattataagggtttgcttactgagcgcgagggggagaataaggaggcccgccgcaactggaaaaaaatcgcgaatattaaagatttaaaacgcggttacttaagccaagttgttcacatcatttccaagatgatggttgagtacaacgcgatcgtcgtccttgaggaccttaaccctggttttatccgtggtcgtcaaaagattgaacgcaatgtctacgaacaatttgagcgcatgttaattgataagttaaacttttacgtagacaaacataaaggcgccaacgaaaccggtggacttttgcacgcattacagcttacatcggaatttaaaaatttcaagaagagcgagcatcagaatgggtgtctgttttacatcccagcctggaacacctcaaagatcgaccccgctacgggctttgtcaaccttttcaacacgaaatatacgaacgcagtagaagctcaggagtttttctcaaaatttgatgagatccgttacaacgaagaaaaggattggtttgagtttgaatttgactacgacaagttcacacagaaggcgcatggaactcgcacgaaatggacactgtgcacgtatggaatgcgcctgcgtagtttcaagaatagtgctaagcaatacaattgggatagtgaggtcgtagctttgactgaggaattcaagcgtattttgggggaggctgggattgatatccacgaaaatcttaaagatgcaatctgcaatttggaaggtaaaagtcaaaaatacttggagccacttatgcaatttatgaagctgcttttgcagttacgcaattctaaagcgggcacggatgaagactacatcttatcgccagtggccgatgagaatggaatcttctacgattctcgttcttgcggagatcaattaccggagaatgcagatgcaaacggagcctataatatcgcgcgcaaagggcttatgttgatcgaacaaatcaagaatgcagaagacttgaataatgtcaaattcgatattagcaataaggcatggctgaactttgctcagcagaaaccttacaagaatggttga

SEQ ID NO: 141 - DNA, 2616 bp, Artificial Sequence
  Description of Artificial Sequence: Synthetic polynucleotide
attaaagccattaacgagtactacaaacaacttggagcttactgccgcgaagaaggtaaagagaaagatgatttctttaagcgcattgacggtgcttattgcgccatcagccatttattcttcggcgagcatggggaaatcgctcagagtgactccgacgtggagttaatccagaagctgctggaagcctataaagggttacaacgctttatcaagccattactgggtcatggcgacgaagcggacaaggataacgaatttgatgcaaaacttcgcaaggtgtgggacgagttggacatcatcacgccactttacgataaagtgcgtaactggctttcacgcaaaatttataatccggagaagatcaagctgtgtttcgaaaacaatggtaagcttctgtctggatgggttgattcccgtacaaaatcagataacggcactcagtatggaggttacatttttcgcaagaaaaacgaaatcggcgagtatgacttctaccttggaatctcagctgataccaaactgttccgtcgtgacgccgcgatctcatatgacgacggaatgtacgagcgccttgactactaccagttgaagtctaaaacgctgcttggaaattcgtacgtgggcgattatgggttagactctatgaacttattgtctgccttcaagaatgcggcggtcaaatttcaattcgagaaggaggtggtgcccaaggataaggaaaacgtgcctaagtacttaaagcgcttaaagttagattatgctggattttaccaaatcttgatgaatgatgacaaggtagtagacgcttacaagatcatgaaacaacacatcttagcaactcttacatcctcaatccgtgtaccagccgctatcgaattggcgacacaaaaagagctgggaatcgacgaattgatcgatgaaatcatgaacttgccatccaaatcttttgggtacttcccgattgtgacggctgctatcgaagaggcaaacaaacgtgaaaataagcccttatttttgtttaaaatgagtaacaaagatttaagttatgccgcaacggctagcaagggattgcgcaagggtcgcggaacagaaaatttgcactccatgtacctgaaggcgttgcttgggatgacccaatctgtgttcgatattggtagcggcatggttttttttcgccatcagaccaagggtttagcagaaactacggcccgtcataaggccaacgaattcgtagcaaataaaaacaaactgaatgacaagaagaaaagtatctttgggtacgagatcgtgaagaacaaacgctttacagttgacaagtacttgttcaagcttagtatgaacctgaactactcacaacccaataataacaagatcgatgttaactcaaaggtacgcgagattattagcaacgggggtatcaaaaacatcattgggattgatcgtggtgagcgtaatctgttatacttgtccctgatcgacttgaaaggtaacatcgtcatgcaaaaaagcctgaatattcttaaggacgaccacaacgccaaggagacagactacaaaggcttgttaactgaacgtgaaggagaaaataaggaagcacgccgtaattggaaaaagatcgcaaacattaaggacctgaaacgcgggtacttgtctcaggtcgtccatattatttccaaaatgatggtcgaatataatgcgatcgtagtgcttgaagacctgaatcccggcttcatccgtgggcgtcaaaaaattgaacgtaatgtctatgaacagtttgagcgtatgttgattgacaaactgaacttctacgtagataagcataagggagcgaatgaaaccggcggccttttacacgcgttgcagttaacgagtgagttcaaaaacttcaaaaagtccgagcaccaaaatgggtgcctgttttacatccccgcgtggaatacgagtaagattgatcctgcaactgggttcgtgaacttatttaataccaaatatacgaatgccgttgaagcccaagaattcttctccaaattcgatgagatccgttacaatgaggaaaaagattggttcgagttcgagttcgactacgacaagtttacacagaaagctcatggtacgcgcactaagtggactttatgtacgtacggaatgcgtttgcgctcctttaaaaactctgcaaaacagtacaactgggacagcgaagtagtggcattaaccgaagaattcaagcgtattttaggggaagcgggtatcgatattcacgaaaatttaaaggatgctatttgtaatttggaaggcaaaagtcaaaagtacttggaaccgttaatgcaattcatgaaattgttgctgcaattgcgcaactcgaaagcggggaccgatgaagattatattctgagccctgtggcggacgagaacgggatcttttatgacagccgttcttgtggtgaccaacttcccgaaaatgctgatgcaaatggggcatataacattgctcgtaaaggattaatgctgatcgaacaaatcaaaaatgccgaagatttaaacaatgtcaagtttgatatcagtaacaaggcgtggttgaactttgctcagcaaaaaccgtataagaatggttga

SEQ ID NO: 142 - DNA, 2616 bp, Artificial Sequence
  Description of Artificial Sequence: Synthetic polynucleotide
attaaggcaattaacgagtactacaaacaattaggcgcgtattgccgtgaagaaggaaaggaaaaggacgacttcttcaagcgtatcgatggtgcgtactgcgcgatcagccacctttttttcggggagcatggagaaattgcacagtccgattctgacgtagaattaatccagaagttattagaagcatataaaggcctgcaacgcttcatcaaaccgctgcttggacacggagatgaggcagataaagataatgagttcgatgctaagcttcgtaaagtctgggacgaattggacattatcacgccattgtatgataaggtccgtaattggctgtcccgcaagatttacaatcctgagaagattaaattatgtttcgagaacaatggcaaactgttgagtgggtgggtcgactctcgtaccaaatcggacaatggaacccagtacggggggtatatttttcgtaagaaaaacgagatcggcgaatacgacttttatttgggtattagtgcagacacaaagttattccgtcgcgatgcggcaatctcttacgatgacgggatgtacgaacgcttagattattatcagttaaaatcaaagaccttgcttggcaactcctacgtcggggattatgggttggacagcatgaacttgttgagtgcctttaagaacgcagccgtaaagtttcagtttgaaaaggaggtagtaccgaaagacaaagaaaacgttcctaaatatcttaaacgtctgaagttggactacgccgggttctaccaaattctgatgaacgacgataaggtagtagacgcctataagattatgaaacaacatattctggccacgttgacaagctctatccgcgtgccagcggctattgagttggcgactcaaaaggaattaggcatcgatgagttgatcgacgaaatcatgaatttgccaagcaagtcattcggttacttccctatcgttactgccgcgattgaagaagcaaacaaacgcgagaacaaaccgctgtttctgttcaaaatgtcgaacaaagacttgagctacgctgcaaccgcttccaaaggacttcgcaagggacgcggcacagaaaatttacactccatgtatttgaaggcattgttaggtatgacccaatcagtttttgacatcggttcgggtatggtattctttcgtcaccagacaaaaggacttgctgagacaacagcgcgccataaggccaacgagttcgtcgctaacaaaaacaagttaaacgacaaaaaaaagtccattttcggatatgaaatcgttaagaacaaacgctttacggttgataagtatctttttaaactgagcatgaacttgaattatagtcagcccaataataacaagatcgatgtcaattccaaagttcgcgagatcatttccaatggtggcatcaaaaacatcatcgggattgaccgcggagaacgtaatttactgtatttatcgttgatcgacctgaaggggaatatcgtaatgcaaaaaagtctgaatatccttaaagatgaccacaacgcaaaggaaacggactacaaggggttattaaccgagcgcgagggcgagaataaagaagcacgccgtaattggaagaaaatcgcgaacatcaaagacttgaagcgcggctacttatcgcaagtggtacatattatctccaagatgatggttgagtacaacgcgatcgtagtattagaagatcttaatccaggatttatccgcgggcgtcagaagattgaacgcaacgtgtatgagcagtttgagcgcatgcttattgataaattgaatttttatgttgataaacataaaggtgcaaatgaaacagggggcttattgcatgctctgcaacttacttcggaatttaagaattttaagaagtcggagcatcagaatgggtgtttattttatatccccgcatggaatacctccaagattgatcccgccacagggttcgttaatctgttcaacacgaaatacaccaatgctgttgaggcacaggaattcttctccaagtttgacgagattcgctacaatgaggaaaaggactggtttgaatttgagtttgactacgacaagtttactcaaaaggcacatggtacacgcaccaaatggacgctttgcacgtacggtatgcgtttacgctcattcaaaaacagcgccaaacaatacaactgggactccgaagtcgtcgcactgactgaggagtttaaacgtattttgggggaagcaggtatcgatattcacgaaaacttgaaggatgctatctgtaacctggagggtaagagccaaaaatacttggagccattaatgcagttcatgaagttgcttctgcaattgcgcaattcgaaagcagggacagatgaggattatattttaagccccgtcgcagacgagaacggcattttctatgatagtcgctcttgtggtgaccaacttccagaaaatgcagacgcgaacggcgcatataacattgctcgcaaagggcttatgctgattgaacaaattaagaatgcggaagacctgaacaacgtaaagtttgacatctcgaacaaggcatggttaaacttcgcacagcagaagccatacaagaatggttga

SEQ ID NO: 143 - protein, 1244 aa, Phocaeicola sp.
METFSGFTNLYPLSKTLRFRLIPVGETLKHFIDSGILEEDQHRAESYVKVKAIIDDYHRAYIENSLSGFELPLESTKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 144 - protein, 1197 aa, Sulfurimonas sp.
MLSNFTNQYQLSKTLRFELKPVGDTLKHIEKSGLIAQDEIRSQEYQEVKTIIDKYHKAFIDEALQNVVLSNLEEYEALFFERNRDEKAFEKLQAVLRKEIVAHFKQHPQYKTLFKKELIKADLKNWQELSDAEKELVSHFDNFTTYFTGFHENRANMYTDEAKHSSIAYRIIHENLPIFLTNKKLFETIKQKAPHLAQETQDALLEYLSGAIVEDMFELSYFNHLLSQTHIDLYNQMIGGVKQDSLKIQGLNEKINLYRQANGLSKRELPNLKPLHKQILSDRETLSWLPESFESDEELMQGVQAYFESEVLAFECCDGKVNLLEKLPELLHQTQDYDFSKVYFKNDLALTAASQAIFKDYRIIKEALWEVNKPKKSKDLVADEEKFFNKKNSYFSIEQIDGALNSAQLSANMMHYFQSESTKVIEQIQLTYNDWKRNSSNKELLKAFLDALLSYQRLLKPLNAPNDLEKDVAFYAYFDAYFTSLCGVVKLYDKVRNFMTKKPYSLEKFKLNFENSTLLDGWDVNKESDNTAILFRKEGLYYLGIMNKKYNKVFRNISSSQDEGYQKIDYKLLPGANKMLPKVFFSDKNKEYFKPNAKLLERYKAGEHKKGDNFDLDFCHELIDFFKTSIEKHQDWKHFAYQFSPTESYEDLSGFYREVEQQGYKISYKNIAASFIDTLVAEGKLYFFQIYNKDFSPYSKGTPNMHTLYWRALFDEKNLADVIYKLNGQAEIFFRKKSIEYSQEKLQKGHHHEMLKDKFAYPIIKDRRFAFDKFQFHVPITLNFKAEGNENITPKTFEYIRSNPDNIKVIGIDRGERHLLYLSLIDAEGKIVEQFTLNQIINSYNGKDHVIDYHAKLDAKEKDRDKARKEWGTVENIKELKEGYLSHVIHKIATLIIEHGAVVAMEDLNFGFKRGRFKVEKQVYQKFEKALIDKLNYLVDKKKEPHKLGGLLNALQLTSKFQSFEKMGKQNGFLFYVPAWNTSKIDPVTGFVNLFDTRYASVEKSKAFFTKFQSICYNEAKDYFELVFDYNDFTEKAKETRSEWTLCTYGERIVSFRNAEKNHQWDSKTIHLTTEFKNLFGELHGNDVKEYILEQNSVEFFKSLIYLLKITLQMRNSITGTDIDYLVSPVADEAGNFYDSRKADTSLPKDADANGAYNIARKGLMLMHRIQNAEDLKKVNLAISNRDWLRNAQGLDK

SEQ ID NO: 145 - protein, 1252 aa, Prevotella ruminicola
MIDLKQFIGIYPVSKTLRFELRPVGKTQEWIEKNRVLEGDEQKAADYPVVKKLIDDYHKVCIHDSLNHVHFDWEPLKDAIEIFQKTKSDEAKKRLEAEQAMMRKKIAAAIKDFKHFKELTAATPSDLITSVLPEFSDDGSLKSFRGFATYFSGFQENRNNIYSQEAISTGVPYRLVHDNFPKFLSDLEVFERIKSTCPEVINQASAELQPFLEGVMIDDIFSLDFYNSLLTQNGIDFFNQVIGGVSEKDKQKYRGINEFSNLYRQQHKEIAASKKAMTMIPLFKQILSDRDTLSYIPAQIRTEDELVSSITQFYDHITHFEHDGKTINVLSEIVALLGKLDTYDPNGICITARKLTDISQKVYGKWSVIEEKMKEKAIQQYGDISVAKNKKKVDAFLSRKAYSLSDLCFDEEISFSRYYSELPQTLNAISGYWLQFNEWCKSDEKQKFLNNQTGTEVVKSLLDAMMELFHKCSVLVMPEEYEVDKSFYNEFLPLYEELDTLFLLYNKVRNYLTQKPSDVKKFKLNFESPSLASGWDQNKEMKNNAILLFKDGKSYLGVLNAKNKAKIKDAKGDVSSSSYKKMIYKLLSDPSKDLPHKIFAKGNLDFYKPSEYILEGRELGKYKKGPNFDKKFLHDFIDFYKAAISIDPDWSKFNFQYSPTESYDDIGMFFSEIKKQAYKIRFTDISEAQVNEWVDNGQLYLFQLYNKDYAEGAHGRKNLHTLYWENLFTDENLSNLVLKLNGQAELFCRPQSIKKPVSHKIGSKMLNRRDKSGMPIPESIYRSLYQYYNGKKKESELTVAEKQYIDQVIVKDVTHEIIKDRRYTRQEYFFHVPLTFNANADGNEYINEHVLNYLKDNPDVNIIGIDRGERHLIYLTLINQRGEILKQKTFNVVNSYNYQAKLEQREKERDEARKSWDSVGKIKDLKEGFLSAVIHEITNMMIENNAIVVLEDLNFGFKRGRFKVERQVYQKFEKMLIDKLNYLSFKDREAGEEGGILRGYQMAQKFISFQRLGKQSGFLFYIPAAYTSKIDPVSGFVNHFNFSDITNAEKRKDFLMKMDRIEMKNGNIEFTFDYRKFKTFQTDYQNVWTVSTFGKRIVMRIDEKGYKKMVDYEPTNDIIKAFKNKGILLSEGSDLKALIAEIEANATNAGFYSTLLYAFQKTLQMRNSNAVTEEDYILSPVAKDGHQFCSTDEANKGKDAQGNWVSKLPVDADANGAYHIALKGLYLLRNPETKKIENEKWLQFMVEKPYLE

SEQ ID NO: 146 - protein, 1287 aa, Clostridium sp.
MSYNREKMEEKELGKNQNFQEFIGVSPLQKTLRNELIPTETTKKNIAQLDLLTEDEVRAQNREKLKEMMDDYYRDVIDSTLRGELLIDWSYLFSCMRNHLSENSKESKRELERTQDSVRSQIHDKFAERADFKDMFGASIITKLLPTYIKQNSKYSERYDESVKIMKLYGKFTTSLTDYFETRKNIFSKEKISSAVGYRIVEENAEIFLQNQNAYDRICKIAGLDLHGLDNEITAYVDGKTLKEVCSDEGFAKVITQGGIDRYNEAIGAVNQYMNLLCQKNKALKPGQFKMKRLHKQILCKGTTSFDIPKKFENDKQVYDAVNSFTEIVTKNNDLKRLLNITQNANDYDMNKIYVVADAYSMISQFISKKWNLIEECLLDYYSDNLPGKGNAKENKVKKAVKEETYRSVSQLNEVIEKYYVEKTGQSVWKVESYISSLAEMIKLELCHEIDNDEKHNLIEDDEKISEIKELLDMYMDVFHIIKVFRVNEVLNFDETFYSEMDEIYQDMQEIVPLYNHVRNYVTQKPYKQEKYRLYFHTPTLANGWSKSKEYDNNAIILVREDKYYLGILNAKKKPSKEIMAGKEDCSEHAYAKMNYYLLPGANKMLPKVFLSKKGIQDYHPSSYIVEGYNEKKHIKGSKNFDIRFCRDLIDYFKECIKKHPDWNKFNFEFSATETYEDISVFYREVEKQGYRVEWTYINSEDIQKLEEDGQLFLFQIYNKDFAVGSTGKPNLHTLYLKNLFSEENLRDIVLKLNGEAEIFFRKSSVQKPVIHKCGSILVNRTYEITESGTTRVQSIPESEYMELYRYFNSEKQIELSDEAKKYLDKVQCNKAKTDIVKDYRYTMDKFFIHLPITINFKVDKGNNVNAIAQQYIAEQEDLHVIGIDRGERNLIYVSVIDMYGRILEQKSFNLVEQVSSQGTKRYYDYKEKLQNREEERDKARKSWKTIGKIKELKEGYLSSVIHEIAQMVVKYNAIIAMEDLNYGFKRGRFKVERQVYQKFETMLISKLNYLADKSQAVDEPGGILRGYQMTYVPDNIKNVGRQCGIIFYVPAAYTSKIDPTTGFINAFKRDVVSTNDAKENFLMKFDSIQYDIEKGLFKFSFDYKNFATHKLTLAKTKWDVYTNGTRIQNMKVEGHWLSMEVELTTKMKELLDDSHIPYEEGQNILDDLREMKDITTIVNGILEIFWLTVQLRNSRIDNPDYDRIISPVLNNDGEFFDSDEYNSYIDAQKAPLPIDADANGAFCIALKGMYTANQIKENWVEGEKLPADCLKIEHASWLAFMQGERG

SEQ ID NO: 147 - protein, 1295 aa, Limihaloglobus sp.
MSAVFKIKESTMKDFTHQYSLSKTLRFELKPVGETAERIEDFKNQGLKSIVEEDRQRAEDYKKMKRILDDYHKEFIEEVLNDDIFTANEMESAFEVYRKYMASKNDDKLKKEITEIFTDLRKKIAKAFENKSKEYCLYKGDFSKLINEKKTGKDKGPGKLWYWLKAKADAGVNEFGDGQTFEQAEEALAKFNNFSTYFTGFNQNRDNIYTDAEQQTAISYRVINENMTRYFDNCIRYSSIENKYPELVKQLEPLSGKFAPGNYKDYLSQTAIDIYNEAVGHKSDDINAKGINQFINEYRQRNSIKGRELPIMSVLYKQILSDINKDLIIDKFENAGELLDAVKTLHRELTDKKILLKIKQTLNEFLTEDNSEDIYIKSGTDLTAVSNAIWGEWSVIPKALEMYAENITDMNAKAREKWLKREAYHLKTVQEAIEAYLKDNEEFETRNISEYFTNFKSGENDLIQVVQSAYAKMESIFGIEDFHKDRRPVTESGEPGEGFRQVELVREYLDSLINVEHFIKPLHMFRSGKPIELEDCNSNFYDPLNEAYKELDVVFGIYNKVRNYVTQKPYSKDKFKINFQNSTLLDGWDVNKESANSSVLLLKNGKYYLGVMKQGASNILNYRPEPSDSKNKINAKKQLSEIALAGATDDYYEKMIYKLLPDPAKMLPKVFFSAKNIEFYNPSQEIIYIRENGLFKKDAGDKESLKKWIGFMKTSLLKHPEWGSYFNFEFEPAEDYQDISIFYKQVAEQGYSVTFDKIKTSYIEEKVASGELYLFEIYNKDFSPHSKGRPNLHTMYWKSLFEKENLQNLVTKLNGEAEVFFRQHSIKRNEKVVHRANRPIQNKNPLTEKKQSIFEYDLVKDRRFTKDKFFLHCPITLNFKEAGPGRFNDKVNKYIAGNPDIRIIGIDRGERHLLYYSLIDQSGRIVEQGTLNQITSTLNSGGREIPKTTDYRGLLDTKEKERDKARKSWSMIENIKELKSGYLSHIVHKLAKLMVKNNAVVVLEDLNFGFKRGRFKVEKQVYQKFEKALIEKLNYLVFKDARPAEPGHYLNAYQLTAPLESFKKLGKQSGFIYYVPAWNTSKIDPVTGFVNQFYIEKNSMQYLKNFFGKFDSIRFNPDKNYFEFGFDYKNFHNKAAKSKWTICTHGDKRSWYNRKQRKLEIHNVTENLASLLSGKGINFADGGSIKDKILSVDDASFFKSLAFNFKLTAQLRHTFEDNGEEIDCIISPVAAADGTFFCSETAKKLNMELPHDADANGAYNIARKGLMVLRQIRESGKPKPISNADWLDFAQQNED

SEQ ID NO: 148 - protein, 1245 aa, Ruminococcus bromii
MQERKKISHLTHRNSVQKTIRMQLNPVGKTMDYFQAKQILENDEKLKENYQKIKEIADRFYRNLNEDVLSKTGLDKLKDYAEIYYHCNTDAERKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVNYYKTSLMQLTDNLSDKYNEAAPLLNKSYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCRDEKYYLAIIDKSNNSILENIDFQDCDENDCYEKIIYKLLPGPNKMLPKVFFSEKCKKLLSPSDEILKIRKNGTFKKGDKFSLDDCHKLIDFYKESFKKYPNWLIYNFKFKNTNEYNDIREFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKTSTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEGGGLLHAYQLTNKLESFDKLGMQSGFIFYVRPDFTSKIDPVTGFVNLLYPRYENIDKAKDMISRFDDIGYNAGEDFFEFDIDYDKFPKTASDYRKRWTICTNGERIEAFRNPAKNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVGPVIHNDKWLKFVQENDMANN

SEQ ID NO: 149 - protein, 1281 aa, Prevotella sp.
MNILKENYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 150 - protein, 1293 aa, Unknown
  Description of Unknown: Parcubacteria group bacterium sequence
MAKENIFNELTGKYQLSKTLRLELKPVGNTQQMLKDEDVFEKDRIIREKYRETRPHFDRLHREFIEQALKNQKLSDLGKYFQCLAKLQNNKKDKEAQEEFKRISQNLRKEVNDLFKIDPLFGEGVFALLKEKYGEKDDAFLREQDGQYVLDENKKKISIFDSWKGFTGYFTKFQETRKNFYKDDGTATAVATRIIDQNLKRFCENIQIFKSIQKKVDFKEVEDNFSVDLEDIFSLGFYSSCFLQEGIDVYNKILGGEPKTTGEKLRGLNELINRYRQDHKGEKLPFFKMLDKQILSEKEKFIESIEDDEELLKTLKEFYSSAEEKTTVLKELFNDFIKNNENYDLSEIYISREALNTISHRWVSAATLPEFEKSVYEVMKKDKPSGLSFDKDDNSYKFPDFIALSYIKGSFEKLSGEKLWKDGYFRDETRNGDKGFLIGNESLWTQFIKIFEFEFNSLFEAKNTERSVGYYHFKKDFEKIITNDFSVNPEDKVIIREFADNVLAIYQMAKYFAIEKKRKWMDQYDTGDFYNHPDFGYKTKFYDNAYEKIVKARMLLQSYLTKKPFSTDKWKLNFECGYLLNGWSSSFNTYGSLLFRTGNEYYLGVVNGSALRTEKIKRLTGNITEANSCHKMVYDFQKPDNKNVPRIFIRSKGDKFAPAVSELNLPVDSILEIYDKGLFKTENKNSPFFKPSLKKLIDYFKLGFSRHASYKHYQFKWKDSSEYKNISEFYNDTIRSCYQIKWEELNFEEVKKLTNSKDLFLFQIYNKDFSEKSTGNKNLHSIYFDGLFLDNNINAQDGVILKLSGGGEIFFRPKTDVKKLGSRTDTKGKLVIKNKRYSQDKIFLHFPIELNYSNTQESNFNKLVRNFLADNPDINIIGVDRGEKHLIYYAGIDQKGNTLKDKDDKDVLGSLNEINGVNYYKLLEERAKAREKARQDWQNIQGIKDLKMGYISLVVRKLADLIIEYNAILVLEDLNMRFKQIHGGIEKSVYQQLEKALIEKLNFLVNKGEKDPERAGHLLRAYQLTAPFSTFKDMGKQTGVLFYTQASYTSKTCPQCGFRPNIKLHFDNLENAKKMLEKINIVYKDNHFEIGYKVSDFTKTEKTSRGNILYGDRQGKDTFVISSKAAIRYKWFARNIKNNELNRGESLKEHTEKGVTIQYDITECLKILYEKNGIDHSGDITKQSIRSELPAKFYKDLLFYLYLLTNTRSSISGTEIDYINCPDCGFHSEKGFNGCIFNGDANGAYNIARKGMLILKKINQYKDQHHTMDKMGWGDLFIGIEEWDKYTQVVSRS

SEQ ID NO: 151 - protein, 1273 aa, Prevotella sp.
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 152 - protein, 1300 aa, Acinetobacter sp.
MNFQPFFQKFVHLYPISKTLRFELIPQGATQKFISEKQVLLQDEIRARKYPEMKQAIDGYHKDFIQRALSNIDSQVFEQALNTFEDLFLRSQAERATDAYKKDFETAQTKLRELIVHSFEKGEFKQEYKSLFDKNLITNLLKPWVEQQNQIGDSNYTYHEDFNKFTTYFLGFHENRKNIYSKDPHKTALAYRLIHENLPKFLENNKILLKIQNDHPSLWEQLQTLNQTMPQLFDGWDFSQLMQVSFFSNTLTQTGIDQYNTIIGGISEGENRQKIQGINELINLYNQKQDKKNRVAKLKQLYKQILSDRSTLSFLPEKFVDDTELYHAINMFYLEHLHHQSMINGHSYTLLERVQLLINELANYDLSKVYLAPNQLSTVSHQMFGDFGYIGRALNYYYMQVIQPDYEQLLASAKTTKKIEATEKLKTIFLDTPQSLVVIQAAIDEYIQLQPSTKPHTQLTDFIISLLKQYETVADDQSIKVINVFSDIEGKYSCIKGLVNTKSESKREVLQDEKLATDIKAFMDAVNNVIKLLKPFSLNEKLVASVEKDARFYSDFEEIYQSLLIFVPLYNKVRNYITQKPYSTEKFKLNFNKPTLLSGWDANKEADNLSILLRKNGNYYLAIMDTAKGANKAFEPKTLNQLKVDDTTDCYEKMVYKLLSGPSKMFPKAFKAKNNEGNYYPTPELLTSYNNNEHLKNDKNFTLASLHAYIDWCKEYINRNPSWHQFNFKFSPTQSFQDISQFYSEVSSQSYKVHFQTIPSDYIDQLVAEGKLYLFQIYNKDFSPNAKGKENLHTLYFKALFSDENLKQPVFKLSGEAEMFYRPASLQLANTTIHKAGEPMAAKNPLTPNATRTLAYDIIKDRRFTTDKYLLHVPISLNFHAQESMSIKKHNDLVRQMIKHNHQDLHVIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFNAFDSIHYNAQKNYFEFKVNLKQFAGLKAQAAQAEWTICSYGDERHVYQKKNAQQGETVIVNVTEELKVLFAKNNIEVAQSVELKETICTQTQVDFFKRLMWLLQVLLALRYSSSKDKLDYILSPVANAQGEFFDSRHASVQLPQDSDANGAYHIALKGLWVIEQLKAADNLDKVKLAISNDDWLHFAQQKPYLA

SEQ ID NO: 153 - protein, 1205 aa, Pseudobutyrivibrio xylanivorans
MYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTI

SEQ ID NO: 154 - protein, 1306 aa, Prevotella sp.
MAKNFEDFKRLYPLSKTLRFEAKPIGATLDNIVKSGLLEEDEHRAASYVKVKKLIDEYHKVFIDRVLDNGCLPLDDKGDNNSLAEYYESYVSKAQDEDAIKKFKEIQQNLLSIIAKKLTDDKAYANLFGNKLIESYKDKADKTKLIDSDLIQFINTAESTQLVSMSQDEAKELVKEFWGFTTYFEGFFKNRKNMYTPEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNRPLTITKEVFDLNNVLYGKYKKFQKGYLTATGDNVGYTHAVNVWIKFCMDFLDSYDSTCIYDFSSLKPESYLSLDSFYQDVNLLLYKLSFTDVSASFIDQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLVEQIKDAEDLDNVKFDISNKAWLNFAQQKPYKNG

SEQ ID NO: 155 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 156 - protein, 1274 aa, Prevotella copri
MAKNFEDFKRLYSLSKTLRFEAKPIGATLDNIVKSDLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINDYINLYNQKHKDDKLPKLKALFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYYNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFLFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHSNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 157 - protein, 1251 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDELQKQLKDLQAVLRKESVKPIGNGGKYKAGHDRLFGAKLFKDGKELGDLAKFVIAQEGKSSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIKHHTARHDDESVQAGKLGQYFKHGLAGVDNPIQKIHNNHSTIKGFLERERPAGERALPKIKSGKNPEMTQLRQLKELLDNALNVAHFAKLLMTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMIYKLLPGPNKMLPRVFFAKSNLDYYNPSAELLDKYAQGTHKKGDNFNLKDCHALIDFFKAGINKHPEWQNFGFKFSPTSSYRDLSDFYREVEPQGYQVKFVDINADYIDELVEQGQLYLFQIYNKDFSPKAHGKPNLHTLYFRALFSEDNLANPIYKLNGEAQIFYRKASLGMNETTIHRAGEILENKNPDNPKERVFTYDIIKDRRYTQDKFMLHVPITMNFGVQGMTIKEFNKKVNQSIRQYDDVNVIGIDRGERHLLYLTVINSKGEILEQRSLNDITTASANGTQMTTPYHKILDKREIERLNARVGWGEIETIKELKSGYLSHVVHQVSQLMLKYNAIVVLEDLNFGFKRGRFKVEKQIYQNFENALIKKLNHLELKDKADDEIGSYKNALQLTNNFTDLKNIGKQTGFLFYVPAWNTSKIDPETGFVDLLKPRYENIAQSQAFFGKFDKICYNADKDYFEFHIDYAKFTDKAKNSRQTWTICSHGDKRYVYDKTANQNKGATKGINVNDELKSLFARYHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 158 - protein, 1251 aa, Moraxella lacunata
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGPNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 159 - protein, 1251 aa, Moraxella lacunata
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGSNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 160 - protein, 1257 aa, Unknown
  Description of Unknown: Sodaliphilus pleomorphus sequence
MKYTDFTGIYPVSKTLRFELIPQGSTVENMKREGILNNDMHRADSYKEMKKLIDEYHKVFIERCLSDFSLKYDDTGKHDSLEEYFFYYEQKRNDKTKKIFEDIQVALRKQISKRFTGDTAFKRLFKKELIKEDLPSFVKNDPVKTELIKEFSDFTTYFQEFHKNRKNMYTSDAKSTAIAYRIINENLPKFIDNINAFHIVAKVPEMQEHFKTIADELRSHLQVGDDIDKMFNLQFFNKVLTQSQLAVYNAVIGGKSEGNKKIQGINEYVNLYNQQHKKARLPMLKLLYKQILSDRVAISWLQDEFDNDQDMLDTIEAFYNKLDSNETGVLGEGKLKQILMGLDGYNLDGVFLRNDLQLSEVSQRLCGGWNIIKDAMISDLKRSVQKKKKETGADFEERVSKLFSAQNSFSIAYINQCLGQAGIRCKIQDYFACLGAKEGENEAETTPDIFDQIAEAYHGAAPILNARPSSHNLAQDIEKVKAIKALLDALKRLQRFVKPLLGRGDEGDKDSFFYGDFMPIWEVLDQLTPLYNKVRNRMTRKPYSQEKIKLNFENSTLLNGWDLNKEHDNTSVILRREGLYYLGIMNKNYNKIFDANNVETIGDCYEKMIYKLLPGPNKMLPKVFFSKSRVQEFSPSKKILEIWESKSFKKGDNFNLDDCHALIDFYKDSIAKHPDWNKFNFKFSDTQSYTNISDFYRDVNQQGYSLSFTKVSVDYVNRMVDEGKLYLFQIYNKDFSPQSKGTPNMHTLYWRMLFDERNLHNVIYKLNGEAEVFYRKASLRCDRPTHPAHQPITCKNENDSKRVCVFDYDIIKNRRYTVDKFMFHVPITINYKCTGSDNINQQVCDYLRSAGDDTHIIGIDRGERNLLYLVIIDQHGTIKEQFSLNEIVNEYKGNTYCTNYHTLLEEKEAGNKKARQDWQTIESIKELKEGYLSQVIHKISMLMQRYHAIVVLEDLNGSFMRSRQKVEKQVYQKFEHMLINKLNYLVNKQYDAAEPGGLLHALQLTSRMDSFKKLGKQSGFLFYIPAWNTSKIDPVTGFVNLFDTRYCNEAKAKEFFEKFDDISYNDERDWFEFSFDYRHFTNKPTGTRTQWTLCTQGTRVRTFRNPEKSNHWDNEEFDLTQAFKDLFNKYGIDIASGLKARIVNGQLTKETSAVKDFYESLLKLLKLTLQMRNSVTGTDIDYLVSPVADKDGIFFDSRTCGSLLPANADANGAFNIARKGLMLLRQIQQSSIDAEKIQLAPIKNEDWLEFAQEKPYL

SEQ ID NO: 161 - protein, 1245 aa, Phocaeicola sp.
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 162 - protein, 1245 aa, Phocaeicola sp.
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 163 - protein, 1245 aa, Phocaeicola sp.
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKANGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYDEFTKKAEGTKTDWTVCSYGNRIITFRNPDKNSQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLTLSITNREWLSFAQGCCKNG

SEQ ID NO: 164 - protein, 1261 aa, Moraxella lacunata
MLFQDFTHLYPLSKTVRFELKPIGKTLEHIHAKNFLSQDKTMADMYQKVKAILDDYHRDFIADMMGEVKLTKLAEFCDVYLKFRKNPKDDGLQKQLKDLQAVLRKEIVKPIGNGGKYKVGYDRLFGAKLFKDGKELGDLAKFVIAQESESSPKLPQIAHFEKFSTYFTGFHDNRKNMYSSDDKHTAIAYRLIHENLPRFIDNLQILATIKQKHSALYDQIASELTASGLDVSLASHLGGYHKLLTQEGITAYNRIIGEVNSYTNKHNQICHKSERIAKLRPLHKQILSDGMGVSFLPSKFADDSEMCQAVNEFYRHYADVFAKVQSLFDRFDDYQKDGIYVEHKNLNELSKRAFGDFGFLKRFLEEYYADVIDPEFNEKFAKTEPDSDEQKKLAGEKDKFVKGVHSLASLEQVIEYYTAGYDDESVQADKLGQYFKHRLAGVDNPIQKIHNSHSTIKGFLERERPAGERALPKIKSDKSPEMTQLRQLKELLDNALNVVHFAKLVSTETVLDTRSDKFYGEFRPLYVELAKITTLYNKVRDYLSQKPFSTEKYKLNFGNPTLLNGWDLNKEKDNFGVILQKDGCYYLALLDKAHKKVFDNAPNTGKSVYQKMVYKQIANARRDLACLLIINGKVVRKTKGLDDLREKYLPYDIYKIYQSESYKVLSPNFNHQDLVKYIDYNKILASGYFEYFDFRFKESSEYKSYKEFLDDVDNCGYKISFCNINADYIDELVEQGQLYLFQIYNKDFSPKAHGKPNLHTLYFKALFSEDNLANPIYKLNGEAQIFYRKASLDMNETTIHRAGEVLENKNPDNPKQRQFVYDIIKDKRYTQDKFMLHVPITMNFGVQGMTIEGFNKKVNQSIQQYDDVNVIGIDRGERHLLYLTVINSKGEILEQRSLNDIITTSANGTQMTTPYHKILNKKKEGRLQARKDWGEIETIKELKAGYLSHVVHQISQLMLKYNAIVVLEDLNFGFKRGRLKVENQVYQNFENALIKKLNHLVLKDKTDDEIGSYKNALQLTNNFTDLKSIGKQTGFLFYVPARNTSKIDPETGFVDLLKPRYENITQSQAFFGKFDKICYNTDKGYFEFHIDYAKFTDEAKNSRQTWVICSHGDKRYVYNKTANQNKGATKGINVNDELKSLFACHHINDKQPNLVMDICQNNDKEFHKSLMYLLKALLALRYSNANSDEDFILSPVANDEGVFFNSALADDTQPQNADANGAYHIALKGLWVLEQIKNSDDLDKVDLEIKDDEWRNFAQNR

SEQ ID NO: 165 - protein, 1275 aa, Unknown
  Description of Unknown: Lachnospiraceae bacterium sequence
MGKNQNFQEFIGVSPLQKTLRNELIPTETTKKNITQLDLLTEDEIRAQNREKLKEMMDDYYRDVIDSTLHAGIAVDWSYLFSCMRNHLRENSKESKRELERTQDSIRSQIYNKFAERADFKDMFGASIITKLLPTYIKQNPEYSERYDESMEILKLYGKFTTSLTDYFETRKNIFSKEKISSAVGYRIVEENAEIFLQNQNAYDRICKIAGLDLHGLDNEITAYVDGKTLKEVCSDEGFAKAITQEGIDRYNEAIGAVNQYMNLLCQKNKALKPGQFKMKRLHKQILCKGTTSFDIPKKFENDKQVYDAVNSFTEIVMKNNDLKRLLNITQNVNDYDMNKIYVAADAYSTISQFISKKWNLIEECLLDYYSDNLPGKGNAKENKVKKAVKEETYRSVSQLNELIEKYYVEKTGQSVWKVESYISRLAETITLELCHEIENDEKHNLIEDDDKISKIKELLDMYMDAFHIIKVFRVNEVLNFDETFYSEMDEIYQDMQEIVPLYNHVRNYVTQKPYKQEKYRLYFNTPTLANGWSKNKEYDNNAIILMRDDKYYLGILNAKKKPSKQTMAGKEDCLEHAYAKMNYYLLPGANKMLPKVFLSKKGIQDYHPSSYIVEGYNEKKHIKGSKNFDIRFCRDLIDYFKECIKKHPDWNKFNFEFSATETYEDISVFYREVEKQGYRVEWTYINSEDIQKLEEDGQLFLFQIYNKDFAVGSTGKPNLHTLYLKNLFSEENLRDIVLKLNGEAEIFFRKSSVQKPVIHKCGSILVNRTYEITESGTTRVQSIPESEYMELYRYFNSEKQIELSDEAKKYLDKVQCNKAKTDIVKDYRYTMDKFFIHLPITINFKVDKGNNVNAIAQQYIAEQEDLHVIGIDRGERNLIYVSVIDMYGRILEQKSFNLVEQVSSQGTKRYYDYKEKLQNREEERDKARKSWKTIGKIKELKEGYLSSVIHEIAQMVVKYNAIIAMEDLNYGFKRGRFKVERQVYQKFETMLISKLNYLADKSQAVDEPGGILRGYQMTYVPDNIKNVGRQCGIIFYVPAAYTSKIDPTTGFINAFKRDVVSTNDAKENFLMKFDSIQYDIEKGLFKFSFDYKNFATHKLTLAKTKWDVYTNGTRIQNMKVEGHWLSMEVELTTKMKELLDDSHIPYEEGQNILDDLREMKDITTIVNGILEIFWLTVQLRNSRIDNPDYDRIISPVLNNDGEFFDSDEYNSYIDAQKAPLPIDADANGAFCIALKGMYTANQIKENWVEGEKLPADCLKIEHASWLAFMQGERG

SEQ ID NO: 166 - protein, 1261 aa, Moraxella sp.
MNTSLFSSFTRQYPVTKTLRFELKPMGATLGHIQQKGFLHKDEELAKIYKKIKELLDEYHRAFIADTLGDAQLVGLDDFYADYQALKQDSKNSHLKDKLTKTQDNLRKQITKNFEKTPQLKERYKRLFTKELFKAGKDKGDLEKWLINHDSEPNKAEKISWIHQFENFTTYFQGFYENRKNMYSDEVKHTAIAYRLIHENLPRFVDNIQVLSKIKSDYPDLYHELNHLDSRTIDFADFKFDDMLQMDFYHHLLIQSGITAYNTLLGGKVLEGGKKLQGINELINLYGQKHKIKIAKLKPLHKQILSDGQSVSFLPKKFDNDYELCQTVNHFYREYVAIFDELVVLFQKFYDYDKDNIYINHQQLNQLSHELFADFRLLSRALDFYYCQIIDGDFNNKINNAKSQNAKEKLLKEKERYTKSNHSINELQKAINHYASHHEDTEVKVISDYFSATNIRNMIDGIHHHFSTIKGFLEKDNNQGESYLPKQKNSNDVKNLKLFLDGVLRLIHFIKPLALKSDDTLEKEEHFYGEFMPLYDKLVMFTLLYNKVRDYISQKPYNDEKIKLNFGNSTLLNGWDVNKEKDNFGVILCKEGLYYLAILDKSHKKVFDNAPKATSSHTYQKMVYKLLPGPNKMLPKVFFAKSNIGYYQPSAQLLENYEKGTHKKGSNFSLTDCHHLIDFFKSSIAKHPEWKEFGFRFSDTHTYQDLSDFYKEIEPQSYKVKFIDIDADYIDDLVEKGQLYLFQLYNKDFSKQSYGKPNLHTLYFKSLFSDDNLKNPIYKLNGEAEIFYRRASLSVSDTTIHQAGEILTPKNPNNTHNRTLSYDVIKNKRYTTDKFFLHIPITMNFGIENTGFKAFNHQVNTTLKNADKKDVHIIGIDRGERHLLYVSVIDGDGRIVEQRTLNDIVSISNNGMSMSTPYHQILDNREKERLAARTDWGDIKNIKELKAGYLSHVVHEVVQMMLKYNAMIVLEDLNFGFKHGRFKVEKQVYQNFENALIKKLNYLVLKNADNHQLGSVRKALQLTNNFTDIKSIGKQTGFIFYVPAWNTSKIDPTTGFVDLLKPRYENMAQAQSFISRFKKIAYNHQLDYFEFEFDYADFYQKTIDKKRIWTLCTYGDVRYYYDHKTKETKTVNITKELKSLLDKHDLSYQNGHNLVDELANSHDKSLLSGVMYLLKVLLALRYSHAQKNEDFILSPVMNKDGVFFDSRFADDVLPNNADANGAYHIALKGLWVLNQIQSADNMDKIDLSISNEQWLHFTQSR

SEQ ID NO: 167 - protein, 1288 aa, Coprococcus sp.
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYDFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDEIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKKLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDENGRFYDSENYIFNEETELPKDADANGAYCIALKGLYNVIAIKNNWKEGEKFNRKLLSLNNYNWFDFIQNRRF

SEQ ID NO: 168 - protein, 1288 aa, Coprococcus sp.
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYVFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDGIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKRLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDEKGRFYDSENYIFNEETELPKDADANGAYCIALKGLYNVIAIKNNWKEGEKFNRKLLSLNNYNWFDFIQNRRF

SEQ ID NO: 169 - protein, 1245 aa, Ruminococcus sp.
MQEHKKISHLTHRNSVQKTIRMQLNPVGKTMDYFQAKQILENDEKLKEDYQKIKEIADRFYRNLNEDVLSKTGLDKLKDYAEIYYHCNTDADRKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAVDDLDTTYSGLCGTNLYDVFTVDYFNFLLPQSGITEYNKIIGGYTTSDGTKVKGINEYINLYNQQVSKRYKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKRASTFPYDLIKDKRYTKWQFSLHFPITMNFKAPDRAMINDDVRNLLKSCNNNFIIGIDRGERNLLYVSIIDSNGAIIYQHSLNIIGNKFKGKTYETNYREKLETREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDNLKAEILSQTKGKFFEDFFKLLRLTLQMRNSNPETGEDRILSPVKDKNGNFYDSSKYDEKSNLPCDADANGAYNIARKGLWIVEQFKKSDNVSTVEPVIHNDKWLKFVQENDMANN

SEQ ID NO: 170 - protein, 1271 aa, Leptospira sp.
MKNLANFTNLYSLQKTLRFELKPIGKTLDWIIKKDLLKQDEILAEDYKIVKKIIDRYHKDFIDLAFESAYLQKKSSDSFTAIMEASIQSYSELYFIKEKSDRDKKAMEEISGIMRKEIVECFTGKYSEVVKKKFGNLFKKELIKEDLLNFCEPDELPIIQKFADFTTYFTGFHENRENMYSNEEKATAIANRLIRENLPRYLDNLRIIRSIQGRYKDFGWKDLESNLKRIDKNLQYSDFLTENGFVYTFSQKGIDRYNLILGGQSVESGEKIQGLNELINLYRQKNQLDRRQLPNLKELYKQILSDRTRHSFVPEKFSSDKALLRSLLDFHKEVIQNKNLFEEKQVSLLQAIRETLTDLKSFDLDRIYLTNDTSLTQISNFVFGDWSKVKTILAIYFDENIANPKDRQRQSNSYLKAKENWLKKNYYSIHELNEAISVYGKHSDEELPNTKIEDYFSGLQTKDETKKPIDVLDAIVSKYADLESLLTKEYPEDKNLKSDKGSIEKIKNYLDSIKLLQNFLKPLKPKKVQDEKDLGFYNDLELYLESLESANSLYNKVRNYLTGKEYSDEKIKLNFKNSTLLDGWDENKETSNLSVIFRDTNNYYLGILDKQNNRIFESIPEIQSGEETIQKMVYKLLPGANNMLPKVFFSEKGLLKFNPSDEITSLYSEGRFKKGDKFSINSLHTLIDFYKKSLAVHEDWSVFNFKFDETSHYEDISQFYRQVESQGYKITFKPISKKYIDTLVEDGKLYLFQIYNKDFSQNKKGGGKPNLHTIYFKSLFEKENLKDVIVKLNGQAEVFFRKKSIHYDENITRYGHHSELLKGRFSYPILKDKRFTEDKFQFHFPITLNFKSGEIKQFNARVNSYLKHNKDVKIIGIDRGERHLLYLSLIDQDGKILRQESLNLIKNDQNFKAINYQEKLHKKEIERDQARKSWGSIENIKELKEGYLSQVVHTISKLMVEHNAIVVLEDLNFGFKRGRQKVERQVYQKFEKMLIEKLNFLVFKDKEMDEPGGILKAYQLTDNFVSFEKMGKQTGFVFYVPAWNTSKIDPKTGFVNFLHLNYENVNQAKELIGKFDQIRYNQDRDWFEFQVTTDQFFTKENAPDTRTWIICSTPTKRFYSKRTVNGSVSTIEIDVNQKLKELFNDCNYQDGEDLVDRILEKDSKDFFSKLIAYLRILTSLRQNNGEQGFEERDFILSPVVGSDGKFFNSLDASSQEPKDADANGAYHIALKGLMNLHVINETDDESLGKPSWKISNKDWLNFVWQRPSLKA

SEQ ID NO: 171 - protein, 1245 aa, Ruminococcus sp.
MQEHKKISHLTHRNSVQKTIRMQLNPVGKTMDYFQAKQILENDEKLKENYQKIKEIADRFYRNLNEDVLSKTRLDKLKDYTDIYYHCNTDADRKRLDECASELRKEIVKNFKNRDEYNKLFNKKMIEIVLPKHLKNEDEKEVVTSFKNFTTYFTGFFTNRKNMYSDGEESTAIAYRCINENLPKHLDNVKAFEKAISKLSKNAIDDLDTTYSGLCGTNLYDVFTVDYFNFLLPQSGITEYNKIIGGYTTNDGTKVKGINEYINLYNQQVSKRDKIPNLKILYKQILSESEKVSFIPPKFEDDNELLSAVSEFYANDETFDGMPLKKAIDETKLLFGNLDNPSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIYKSGTFKTGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKTSTFPYDLIKDKRYTKWQFSLHFPITMNFKAPDKAMINDDVRNLLKSCNNNFIIGIDRGERNLLYVSVIDSNGAIIYQHSLNIIGNKFKEKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPQYENIDKAKDMISRFDEIRYNAGEDFFEFDIDYDEFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDQWLKFVQENDMANN

SEQ ID NO: 172 - protein, 1245 aa, Ruminococcus bromii
MQEHKKISHLTHRNSVQKTIRMQLNPVGKTMDYFQAKQILENDEKLKEDYQKIKEIADRFYRNLNEDVLSKTGLDKLKDYADIYYHCNTDADRKRLNECASELRKEIVKNFKNRDEYNKLFNKKMIEIVLPKHLKNEDEKEVVASFKNFTTYFTGFFTNRKNMYSDGEESTAIAYRCINENLPKHLDNVKVFEKAISKLSKNAIDDLGATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDKDKEREYGAVLLCKDEKYYLAIIDKSNNSILENIDFQDCNESDYYEKIVYKLLTKINGNLPRVFFSEKRKKLLSPSDEILKIYKSGTFKKGDKFSLDDCHKLIDFYKESFKKYPNWLIYNFKFKNTNEYNDISEFYNDVASQGYNISKMKIPTTFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 173 - protein, 1245 aa, Ruminococcus bromii
MQERKKISHLTHRNSVKKTIRMQLNPVGKTMDYFQAKQILENDEKLKENYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTNDGTKVKGINEYINLYNQQVSKRDKIPNLQILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIRKKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCKDEKYYLAIIDKSNNRILENIDFQDCDESDCYEKIIYKLLPTPNKMLPKVFFAKKHKKLLSPSDEILKIYKNGTFKKGDKFSLDDCHKLIDFYKESFKKYPKWLIYNFKFKKTNGYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKRASTFPYDLIKDKRYTKWQFSLHFPITMNFKDPDKAMINDDVRNLLKSCNNNFIIGIDRGERNLLYVSVINSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYEKIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 174 - protein, 1245 aa, Ruminococcus sp.
MQERKKISHLTHRNSVLKTIGMQLNPVGKTMDYFQAKQILENDEKLKEDYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLQILYKQILSESEKVSFIPPKFEDDNELLSAVSEFYANDETFDEMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENNEIREKSIVDYYKTSLMQLTDNLSDKYNEVAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCRDEKYYLAIIDKSNNRILENIDFQDCDESDCYEKIIYKLLPTPNKMLPKVFFAKKHKKLLSPSDEILKIRKNGTFKKGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYKLNGEAKMFYRPASIKYDKPTHPKNTPIKNKNTLNDKKASTFPYDLIKDKRYTKWQFSLHFSITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 175 - protein, 1278 aa, Ruminococcus sp.
MSININKFSDECRKIDFFTDLYNIQKTLRFSLIPIGATADNFEFKGRLSKEKDLLDSAKRIKEYISKYLADESDICLSQPVKLKHLDEYYELYITKDRDEQKFKSVEEKLRKELADLLKEILKRLNKKILSDYLPEYLEDDEKALEDIANLSSFSTYFNSYYDNCKNMYTDKEQSTAIPYRCINDNLPKFIDNMKAYEKALEELKPSDLEELRNNFKGVYDTTVDDMFTLDYFNCVLSQSGIDSYNAIIGNDKVKGINEYINLHNQTAEQGHKVPNLKRLYKQIGSQKKTISFLPSKFESDNELLKAVYDFYNTGDAEKNFTALKDTITEFEKIFDNLSEYNLDGVFVRNDISLTNLSQSMFNDWSVFRNLWNDQYDKVNNPEKAKDIDKYNDKRHKVYKKSESFSINQLQELIATTLEEDINSKKITDYFSCDFHRVTTEVENKYQLVKDLLSSDYPKNKNLKTSEEDVALIKDFLDSVKSLESFVKILTGTGKESGKDELFYGSFTKWFDQLRYIDKLYDKVRNYITEKPYSLDKIKLSFDNPQFLGGWQHSKETDYSAQLFMKDGLYYLGVMDKETKREFKTQYNTPENDSDTMVKIEYNQIPNPGRVIQNLMLVDGKIVKKNGRKNADGVNAVLEELKNQYLPENINRIRKTESYKTTSNNFNKDDLKAYLEYYIARTKEYYCKYNFVFKSADEYGSFNEFVDDVNNQAYQITKVKVSEKQLLSLVEQGKLYLFKIYNKDFSEYSKGKKNLHTMYFQMLFDDRNLENLVYKLQGGAEMFYRPASIKKDSEFKHDANVEIIKRTCEDKVNDKDNPTDDEKAKYYSKFDYDIVKNKRFTKDQFSLHLTLAMNCNQPDHYWLNNDVRELLKKSNKNHIIGIDRGERNLIYVTIINSDGVIVDQINFNIIENSYNGKKYKTDYQKKLNQREEDRQKARKTWKTIETIKELKDGYISQVVHQICKLIVQYDAIVVMENLNGGFKRGRTKVEKQVYQKFETMLINKLNYYVDKGTDYKECGGLLKAYQLTNKFETFERIGKQSGIIFYVDPYLTSKIDPVTGFANLLYPKYETIPKTHNFISNIDDIRYNQSEDYFEFDIDYDKFPQGSYNYRKKWTICSYGNRIKYYKDSRNKTASVVVDITEKFKETFTNAGIDFVNDNIKEKLLLVNSKELLKSFMDTLKLTVQLRNSEINSDVDYIISPIKDRNGNFYYSENYKKSNNEVPSQPQDGDANGAYNIARKGLMIINKLKKADDVTNNELLKISKKEWLEFAQKGDLGE

SEQ ID NO: 176 - protein, 1562 aa, Leptospira sp.
MKATSIWDNFTRKYSVSKTLRFELRPVGKTEENIVKKEIIDAEWISGKNIPKGTDADRARDYKIVKKLLNQLHILFINQALSSENVKEFEKEDKKSKTFVAWSDLLATHFDNWIQYTRDKSNSTVLKSLEKSKKDLYSKLGKLLNSKANAWKAEFISYHKIKSPDNIKIRLSASNVQILFGNTSDPIQLLKYQIELDNIKFLKDDGSEYTTKELADLLSTFEKFGTYFSGFNQNRANVYDIDGEISTSIAYRLFNQNIEFFFQNIKRWEQFTSSIGHKEAKENLKLVQWDIQSKLKELDMEIVQPRFNLKFEKLLTPQSFIYLLNQEGIDAFNTVLGGIPAEVKAEKKQGVNELINLTRQKLNEDKRKFPSLQIMYKQIMSERKTNFIDQYEDDVEMLKEIQEFSNDWNEKKKRHSASSKEIKESAIAYIQREFHETFDSLEERATVKEDFYLSEKSIQNLSIDIFGGYNTIHNLWYTEVEGMLKSGERPLTRVEKEKLKKQEYISFAQIERLISKHSQQYLDSTPKEANDRSLFKEKWKKTFKNGFKVSEYTNLKLNELISEGETFQKIDQETGKETTIKIPGLFESYENAILVESIKNQSLGTNKKESVPSIKEYLDSCLRLSKFIESFLVNSKDLKEDQSLDGCSDFQNTLTQWLNEEFDVFILYNKVRNHVTKKPGNTDKIKINFDNATLLDGWDVDKEAANFGFLLKKADNYYLGIADSSFNQDLKYFNEGERLDEIEKNRKNLEKEESKNISKIDQEKVKKYKEVIDDLKAISNLNKGRYSKAFYKQSKFTTLIPKCTTQLNEVIEHFKKFDTDYRIENKKFAKPFIITKEVFLLNNTVYDTATKKFTLKIGEDEDTKGLKKFQIGYYRATDDKKGYESALRNWITFCIEFTKSYKSCLNYNYSSLKSVSEYKSLDEFYKDLNGIGYTIDFVDISEEYINKKINEGKLYLFQIYNKDFSEKSKGKENLHTTYWKLLFDSKNLEDVVIKLNGQAEVFFRPASIHEKEKITHFKNQEIQNKNPNAVKKTSKFEYDIIKDNRFTKNKFLFHCPITLNFKADGNPYVNNEVQENIAKNPNVNIIGIDRGEKHLLYFTVINQQGQILDAGSLNSIKSEYKDKNQQSVSFETPYHKILDKKESERKEARESWQEIENIKELKAGYLSHVVHQLSNLIVKYNAIVVLEDLNKGFKRGRFKVEKQVYQKFEKSLIEKLNYLVFKDRKESNEPGHHLNAYQLTNKFLSFERLGKQSGVLFYATASYTSKVDPVTGFMQNIYDPYHKEKTREFYKNFTKIVYNGNYFEFNYDLNSVKPDSEEKRYRTNWTVCSCVIRSEYDSNSKTQKTYNVNDQLVKLFEDAKIKIENGNDLKSTILEQDDKFIRDLHFYFIAIQKMRVVDSKIEKGEDSNDYIQSPVYPFYCSKEIQPNKKGFYELPSNGDSNGAYNIARKGIVILDKIRLRVQIEKLFEDGTKIDWQKLPNLISKVKDKKLLMTVFEEWAELTHQGEVQQGDLLGKKMSKKGEQFAEFIKGLNVTKEDWEIYTQNEKVVQKQIKTWKLFSNST

SEQ ID NO: 177 - protein, 871 aa, Prevotella sp.
MKAINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 178 - RNA, 56 nt, Artificial Sequence
  Description of Artificial Sequence: Synthetic oligonucleotide
gucuaaaagaccauaugaauuucuacuuucguagaucugaugguccaugucuguua

SEQ ID NO: 179 - RNA, 56 nt, Artificial Sequence
  Description of Artificial Sequence: Synthetic oligonucleotide
gucuaaaggccuuauaaaauuucuacugucguagaucugaugguccaugucuguua

SEQ ID NO: 180 - RNA, 55 nt, Artificial Sequence
  Description of Artificial Sequence: Synthetic oligonucleotide
gucuauacagacacuuuaauucuacuauuguagaucugaugguccaugucuguua

SEQ ID NO: 181 - RNA, 56 nt, Artificial Sequence
  Description of Artificial Sequence: Synthetic oligonucleotide
gucugaaagacaaguauaauuucuacuauuguagaucugaugguccaugucuguua

SEQ ID NO: 182 - RNA, 56 nt, Artificial Sequence
  Description of Artificial Sequence: Synthetic oligonucleotide
ggcuauaagccuuguauaauuucuacuauuguagaucugaugguccaugucuguua

SEQ ID NO: 183 - RNA, 56 nt, Artificial Sequence
  Description of Artificial Sequence: Synthetic oligonucleotide
guugaaacuguaagcggaaugucuacuuggguagaucugaugguccaugucuguua

SEQ ID NO: 184 - RNA, 56 nt, Artificial Sequence
  Description of Artificial Sequence: Synthetic oligonucleotide
gcaugagaaccaugcauuucuaagguacuccaaaaccugaugguccaugucuguua

SEQ ID NO: 185 - RNA, 55 nt, Artificial Sequence
  Description of Artificial Sequence: Synthetic oligonucleotide
guugaguaaccuuaaauaauuucuacuguuguagaucugugguccaugucuguua

SEQ ID NO: 186 - RNA, 56 nt, Artificial Sequence
  Description of Artificial Sequence: Synthetic oligonucleotide
aucuacaacaguagaaauuuaagcuaaggcuuagaccugaugguccaugucuguua

SEQ ID NO: 187 - RNA, 40 nt, Artificial Sequence
  Description of Artificial Sequence: Synthetic oligonucleotide
uaauuucuacucuuguagaucugaugguccaugucuguua

SEQ ID NO: 188 - RNA, 40 nt, Artificial Sequence; identical to SEQ ID NO: 187
  Description of Artificial Sequence: Synthetic oligonucleotide

SEQ ID NO: 189 - DNA, 36 bp, Artificial Sequence
  Description of Artificial Sequence: Synthetic oligonucleotide
gtctatatgacaaagtaatttctactatgtgtagat

SEQ ID NO: 190 - DNA, 36 bp, Artificial Sequence
  Description of Artificial Sequence: Synthetic oligonucleotide
gtctaaaggtaccaccaaatttctactgttgtagat

SEQ ID NO: 191 - DNA, 36 bp, Artificial Sequence
  Description of Artificial Sequence: Synthetic oligonucleotide
ggtataaaccatagtaaaatttctgctattgcagat

SEQ ID NO: 192 - DNA, 36 bp, Artificial Sequence
  Description of Artificial Sequence: Synthetic oligonucleotide
gttgaataaccttaaataatttctactgttgtagat

SEQ ID NO: 193 - DNA, 33 bp, Artificial Sequence
  Description of Artificial Sequence: Synthetic oligonucleotide
ctctaagaggcatataaaatttctactgttgta

SEQ ID NO: 194 - DNA, 36 bp, Artificial Sequence
  Description of Artificial Sequence: Synthetic oligonucleotide
gtttaataaccctatataatttctactattgtagat

SEQ ID NO: 195 - DNA, 36 bp, Artificial Sequence
  Description of Artificial Sequence: Synthetic oligonucleotide
ggctataatgcctaagtaatttctactattgtagat

SEQ ID NO: 196 - DNA, 36 bp, Artificial Sequence
  Description of Artificial Sequence: Synthetic oligonucleotide
gtttaatacacctataagatttctacttttgtagat

SEQ ID NO: 197 - DNA, 36 bp, Artificial Sequence; identical to SEQ ID NO: 195
  Description of Artificial Sequence: Synthetic oligonucleotide

SEQ ID NO: 198 - DNA, 36 bp, Artificial Sequence
  Description of Artificial Sequence: Synthetic oligonucleotide
ggctaacagccttttaaatttctactgtgtgtagat

SEQ ID NO: 199 - DNA, 36 bp, Artificial Sequence
  Description of Artificial Sequence: Synthetic oligonucleotide
gcttagaacctttaaataatttctactattgtagat

SEQ ID NO: 200 - DNA, 36 bp, Artificial Sequence
  Description of Artificial Sequence: Synthetic oligonucleotide
ggctagtatgcttcaataatttctactattgtagat

SEQ ID NO: 201 - DNA, 36 bp, Artificial Sequence; identical to SEQ ID NO: 200
  Description of Artificial Sequence: Synthetic oligonucleotide

SEQ ID NO: 202 - DNA, 36 bp, Artificial Sequence; identical to SEQ ID NO: 200
  Description of Artificial Sequence: Synthetic oligonucleotide

SEQ ID NO: 203 - DNA, 36 bp, Artificial Sequence
  Description of Artificial Sequence: Synthetic oligonucleotide
gtctaacgaccttttaaatttctactgtttgtagat

SEQ ID NO: 204 - DNA, 36 bp, Artificial Sequence; identical to SEQ ID NO: 203
  Description of Artificial Sequence: Synthetic oligonucleotide

SEQ ID NO: 205 - DNA, 36 bp, Artificial Sequence; identical to SEQ ID NO: 203
  Description of Artificial Sequence: Synthetic oligonucleotide

SEQ ID NO: 206 - DNA, 37 bp, Artificial Sequence
  Description of Artificial Sequence: Synthetic oligonucleotide
ggctacataaagcctataatttctactatgtgtagat

SEQ ID NO: 207 - DNA, 36 bp, Artificial Sequence
  Description of Artificial Sequence: Synthetic oligonucleotide
gtctatatgactaagtaatttctactatgtgtagat

SEQ ID NO: 208 - DNA, 36 bp, Artificial Sequence; identical to SEQ ID NO: 207
  Description of Artificial Sequence: Synthetic oligonucleotide

SEQ ID NO: 209 - DNA, 36 bp, Artificial Sequence; identical to SEQ ID NO: 207
  Description of Artificial Sequence: Synthetic oligonucleotide

SEQ ID NO: 210 - DNA, 36 bp, Artificial Sequence; identical to SEQ ID NO: 203
  Description of Artificial Sequence: Synthetic oligonucleotide

SEQ ID NO: 211 - DNA, 36 bp, Artificial Sequence; identical to SEQ ID NO: 192
  Description of Artificial Sequence: Synthetic oligonucleotide

SEQ ID NO: 212 - DNA, 36 bp, Artificial Sequence
  Description of Artificial Sequence: Synthetic oligonucleotide
gtctaacgacctttaaaatttctactatttgtagat

SEQ ID NO: 213 - DNA, 36 bp, Artificial Sequence
  Description of Artificial Sequence: Synthetic oligonucleotide
gttaagtaacctatagtaatttctactgttgtagat

SEQ ID NO: 214 - DNA, 36 bp, Artificial Sequence; identical to SEQ ID NO: 213
  Description of Artificial Sequence: Synthetic oligonucleotide

SEQ ID NO: 215 - DNA, 36 bp, Artificial Sequence; identical to SEQ ID NO: 194
  Description of Artificial Sequence: Synthetic oligonucleotide

SEQ ID NO: 216 - DNA, 36 bp, Artificial Sequence
  Description of Artificial Sequence: Synthetic oligonucleotide
ctctaagagaaggtataaatttctactgttgtagat

SEQ ID NO: 217 - DNA, 36 bp, Artificial Sequence; identical to SEQ ID NO: 194
  Description of Artificial Sequence: Synthetic oligonucleotide

SEQ ID NO: 218 - DNA, 36 bp, Artificial Sequence; identical to SEQ ID NO: 194
  Description of Artificial Sequence: Synthetic oligonucleotide

SEQ ID NO: 219 - DNA, 36 bp, Artificial Sequence; identical to SEQ ID NO: 194
  Description of Artificial Sequence: Synthetic oligonucleotide

SEQ ID NO: 220 - DNA, 37 bp, Artificial Sequence
  Description of Artificial Sequence: Synthetic oligonucleotide
gtttaataaccctatataatttctactattgtagata

SEQ ID NO: 221 - DNA, 36 bp, Artificial Sequence
  Description of Artificial Sequence: Synthetic oligonucleotide
gtttaatcaacccttagaatttctactattgtagat

SEQ ID NO: 222 - DNA, 36 bp, Artificial Sequence
  Description of Artificial Sequence: Synthetic oligonucleotide
ctctaagagaggatataaatttctactgttgtagat

SEQ ID NO: 223 - DNA, 36 bp, Artificial Sequence; identical to SEQ ID NO: 195
  Description of Artificial Sequence: Synthetic oligonucleotide

SEQ ID NO: 224 - protein, 10 aa, Unknown
  Description of Unknown: ART nuclease motif sequence
YLFQIYNKDF

SEQ ID NO: 225 - DNA, 3618 bp, Artificial Sequence
  Description of Artificial Sequence: Synthetic polynucleotide
atgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtattttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgatttaa

SEQ ID NO: 226 - DNA, 3618 bp, Artificial Sequence
  Description of Artificial Sequence: Synthetic polynucleotide
atgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttctttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatctaa

SEQ ID NO: 227 - DNA, 3618 bp, Artificial Sequence
  Description of Artificial Sequence: Synthetic polynucleotide
atgtactatcaaggtctgactaagttgtatcctatttcaaagactatccgtaacgagttaatcccggtaggcaaaacgctagagcacattagaatgaacaacatcttggaggctgatatacagagaaaaagtgactatgaaagggtgaagaagttgatggatgactatcataaacagttaattaatgagagcctgcaagatgtccacctgtcttacgttgaagaggccgcagacttgtacctaaacgccagcaaagataaggacatagtagataaattttctaaatgtcaagataagttaagaaaagagattgtcaatttgctaaaaagccacgaaaattttccgaaaatcggtaacaaggagattatcaaacttttgcagtctttgagtgatactgagaaggattataatgccctagattctttttccaaattctacacgtactttacgtcatataacgaagtaagaaaaaatttatattccgacgaagagaagagttccacagcggcctacagactaataaacgagaacctaccaaagtttcttgacaatataaaggcttactctatagctaagtcagctggcgttcgtgcgaaggaactaacagaagaggagcaggactgtctatttatgaccgaaacatttgagagaactttgacgcaggacggaatagataattacaatgagcttatcgggaagctgaacttcgccattaatctatataaccaacagaataacaagttgaaggggttcaggaaggtgcccaagatgaaggaactgtataaacagatcttatccgagagagaggcatcatttgtagacgagttcgtcgatgatgaggctcttctaaccaacgtcgaaagctttagtgcgcacatcaaggaattcctggagagtgatagtctatcaaggttcgcggaagttttagaggaatccggaggcgagatggtgtatatcaaaaatgatacgtctaagacaacattctcaaacatcgtgttcgggtcttggaatgtgattgacgaaagactagcagaagaatatgattctgctaacagcaagaagaaaaaggacgaaaagtattacgataagaggcataaagagctaaagaagaacaaaagctatagcgtcgagaagatagtctctttaagcacagaaacggaagatgtgatagggaaatacatcgaaaaattacaggctgacataattgcaattaaagagacgagggaggtattcgaaaaggtagttttaaaagaacatgataaaaataagtctctgcgtaaaaataccaaggcgatcgaagccatcaagagcttcttggatactatcaaggattttgagagggatatcaaattgatctccggtagcgaacatgaaatggaaaagaaccttgctgtatatgcggaacaggaaaatattttatcttctattcgtaatgtagattcactgtataacatgtctagaaattaccttacacaaaagccgttctctactgagaaatttaaattaaacttcaaccgtgcgacactgcttaatggttgggataaaaacaaggaaacagacaatctaggaattcttctggtaaaagaaggtaaatattacctagggatcatgaatacgaaggctaacaaatcttttgtcaacccccccaaacctaagactgacaatgtataccataaagtgaattataaactgcttccaggtccaaataaaatgttacctaaggtcttttttgcaaagtcaaatctggagtactacaaaccatctgaagatctgctggcaaagtaccaggccggaacacataaaaagggagaaaacttttccttagaagattgtcactccctgatatcattctttaaagacagcctggagaagcatcccgactggtctgagtttggcttcaagttcagtgacacaaaaaaatacgacgacttaagcggattttacagggaagtcgaaaaacagggttataagataacttatacagatattgacgtagagtacatagacagccttgttgaaaaagatgaattgtacttcttccaaatttataacaaagacttctcaccctacagcaagggtaactacaaccttcataccttgtaccttaccatgctatttgatgaaaggaatttaagaaacgttgtttataagttaaacggcgaagcagaggtcttttaccgtcctgcatccatagggaaggacgaattaataatccataaaagtggagaggagattaagaataaaaaccctaagagagcaattgacaaaccgacatcaacgtttgagtacgatatcgtcaaagaccgtcgttacactaaggacaagttcatgttacatattcctgtgacgatgaactttggcgtggacgaaacacgtaggttcaacgaggtagtaaacgacgccataagaggcgacgacaaagtgagagttataggcatagataggggtgaaagaaatcttctttatgttgtagtagtggactcagacggaactattctagaacaaattagtttaaattccatcatcaacaacgaatacagtattgaaaccgactaccacaaattgctagatgagaaagagggggatagagaccgtgccagaaaaaactggaccacgatcgagaacattaaagaattaaaggaaggatatttaagtcaggtcgtcaacgtgatcgctaaactagtccttaagtatgacgcgatcatatgtctggaagaccttaactttggttttaagagaggaaggcagaaggtggaaaaacaagtgtatcagaagtttgagaaaatgttgatagataagttaaactacctggttattgataagtcccgtagtcaggagaacccggaagaggtggggcatgtcctgaacgcgctacaacttacgtctaagtttacgagctttaaagaactaggcaagcagacgggaataatctactatgtacccgcgtatttaacatccaaaattgatccaacgacagggttcgctaaccttttctacgttaagtacgaatccgttgagaaatctaaagatttctttaacaggtttgacagtatatgctttaacaaggtagcaggctattttgaattctccttcgattacaaaaatttcaccgaccgtgcatgtggtatgcgttctaagtggaaagtctgtactaatggggagaggatcattaagtaccgtaacgaagaaaagaacagtagtttcgacgataaagtgatagtcctgaccgaggagtttaagaagctgttcaacgaatacggcatcgcctttaacgactgcatggacttaacggacgcaataaacgctatagatgacgcatcctttttccgtaagttaaccaagttatttcaacagactcttcaaatgcgtaatagttccgcggacgggtcccgtgattatatcatttcaccagtagagaacgataatggggagttttttaacagcgagaagtgcgataaaagtaaaccgaaagatgcagatgccaacggcgcatttaacattgcgcgtaaggggctgtgggttttagaacagttgtacaacagtagtagtggagagaagcttaacctagctatgacgaatgcagaatggctagagtacgcccaacagcatacgatctaa

SEQ ID NO: 228 - DNA, 3618 bp, Artificial Sequence
  Description of Artificial Sequence: Synthetic polynucleotide
atgtattaccagggtctgaccaagctctatcccatatcaaaaacgatccggaatgagttgatccccgtgggcaaaaccctcgaacatattagaatgaataatatactcgaggcagacattcaaaggaagagcgattatgaaagagttaaaaaactcatggatgactaccataagcaacttataaacgagagtttgcaggacgtgcacctctcatatgtcgaagaagcggcggacctctacctcaacgctagcaaagataaggacattgttgataagttctctaaatgtcaagacaagctcagaaaagaaatcgtaaatcttcttaaaagccacgaaaattttcctaaaataggcaacaaggaaattattaaattgctccaaagcttgtccgacacggaaaaagattataacgccctggactcattctctaaattctacacatacttcacctcttataacgaggttcgcaagaacctctatagtgatgaggagaagtcctcaacggcggcttaccgcctgataaacgagaatcttcccaaatttctcgataacataaaggcgtattccatcgcgaaaagtgcaggcgttagagctaaagagctcactgaagaagaacaagattgccttttcatgaccgagacgtttgaaagaacgctcactcaggacgggattgataattataacgaacttatcgggaagctgaacttcgcaattaatctttataatcaacaaaacaataagctgaaggggtttaggaaagtaccaaagatgaaggaactgtacaagcagatcctcagcgaaagggaagctagttttgtggacgaatttgttgatgacgaagcccttctgaccaacgtagaatctttcagcgcccatattaaagaattcctcgaatctgacagcctctctcgatttgcggaggtccttgaagagtccggtggcgaaatggtgtacataaagaacgacacgtctaagacaacattttctaatattgtgttcggttcatggaacgtcattgacgaaaggttggcagaagaatatgactcagcaaactccaaaaagaagaaggacgagaaatactatgataaaaggcataaggagctgaagaaaaacaaatcttattcagtagagaagatagtctcactgtcaacggagaccgaggacgttataggaaagtatattgaaaagctccaggccgacataattgcgataaaagagactagagaggtgtttgagaaggtcgtcctcaaagagcatgacaagaataaatctctccgaaagaatacgaaagcaatagaggcgattaagtccttcctcgacacaatcaaggatttcgagcgagacatcaagctcatttcagggagtgagcatgagatggaaaaaaatctcgcagtttatgcggagcaagagaacatattgtctagtatccgcaatgtcgacagtctctataacatgagcaggaattatctcacacagaaaccattttcaactgagaagttcaaattgaacttcaaccgggcaaccttgttgaacggttgggacaaaaacaaagagactgacaacctggggattttgctggtgaaggaaggcaagtactatctggggattatgaataccaaagctaacaaaagcttcgtcaaccctccgaagccgaaaacggataatgtctatcataaggtgaattataagctcctgccgggcccaaataagatgcttcccaaagtattcttcgctaagtccaatttggagtattacaaaccaagcgaggacctcttggcaaaataccaagcgggaacgcacaagaagggtgagaatttttcacttgaagattgccattccctgattagtttcttcaaggactcccttgaaaagcacccagactggagtgagttcggtttcaagttttctgatacgaaaaaatacgatgacttgagcggtttctaccgggaggtcgaaaagcaaggttataaaattacatacacagacatagatgtggagtacatcgacagtctggttgagaaagacgagttgtacttcttccagatctataataaagattttagtccctactctaagggaaactacaatcttcatacactttatctgaccatgctgtttgacgaacggaaccttcgcaacgtcgtctacaaactgaacggagaagccgaagtattctatagacccgctagcattggcaaagacgagctgataatccataaatcaggggaggaaattaaaaacaagaacccgaagcgcgctatcgacaaacccacaagcacatttgagtacgacatcgtaaaggatcgaaggtatacaaaagataaatttatgctgcacattcccgtaacgatgaattttggggttgacgaaacgcggagattcaatgaagtggtgaatgacgcaataaggggtgacgataaggttcgcgtgatcggtatagataggggcgagcgaaacctcctctatgtcgtcgtcgtggactctgatggtactattttggagcaaatctctcttaacagtattatcaataacgaatactctattgaaacggactaccataagctgctggatgaaaaagagggtgatcgagatcgggcacggaaaaattggactacaattgagaatatcaaagagttgaaggaagggtatctgtctcaggttgtgaatgttattgcaaagctcgtgctgaagtacgatgccattatttgtcttgaggatttgaactttggttttaagaggggaaggcagaaagtagagaagcaagtctaccagaagtttgagaagatgttgatcgacaaattgaattaccttgttatagataaatccaggagtcaggagaacccggaagaggtgggccatgtcctcaacgctttgcaactcacgtccaagttcacgtcctttaaagaactgggcaagcagactggaattatctactacgtgccggcctacctcactagcaagatcgaccctactaccggcttcgcaaacctcttctacgtaaaatacgagtcagtagaaaaatccaaggatttcttcaatcgctttgatagcatatgttttaataaggttgccggatacttcgaattcagtttcgattataagaacttcaccgatcgggcgtgcggcatgaggtccaagtggaaggtatgtacaaatggggagcgaatcataaaataccgcaatgaggagaagaattcctccttcgacgacaaagtcattgttttgacggaggagtttaaaaaattgtttaacgaatatggaattgccttcaacgactgcatggaccttacggatgcaatcaacgcgatcgatgacgcgtccttttttagaaaattgaccaagctgtttcaacagactctccaaatgaggaactcatcagctgatggaagtagagattatataatatcacctgtagaaaatgacaacggggagttctttaactcagaaaagtgcgataagtccaagcccaaagacgccgatgcaaatggagcgttcaacatagcccggaagggattgtgggtacttgaacagctgtataattcttctagcggcgaaaagctcaaccttgcgatgacaaatgccgagtggcttgaatatgcgcagcaacacaccatataa

SEQ ID NO: 229 - protein, 1205 aa, Artificial Sequence
  Description of Artificial Sequence: Synthetic polypeptide
MYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYFFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTI

SEQ ID NO: 230 - DNA, 3831 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtcaaattttacaaatcagtaccaactttcaaaaaccttgcgttttgaactcaaacctgtaggtgatacacttaagcatatagagaaaagtggcttgatagcacaagatgaaatacgctcacaagagtatcaagaagtaaaaacgattatcgataaataccacaaagcttttattgatgaagcacttcaaaatgttgtgcttagtaatcttgaagagtacgaagcactttttttcgagagaaatcgcgatgaaaaagcttttgaaaaattgcaagctgtattgcgtaaagagatagttgcacattttaagcaacaccctcaatacaaaacactttttaaaaaagagcttattaaagctgatttgaaaaattggcaagaactaagcgacgcagaaaaagagcttgtaagccactttgataacttcacaacctactttacaggttttcatgaaaatcgtgccaatatgtacacagatgaagcgaaacactcttctatcgcttaccgtattatccacgaaaatttgcctatttttttaacaaataaaaaactttttgaaacaatcaagcaaaaagcaccacaccttgcacaagaaacgcaagatgccttgcttgaatatttaagtggtgcaatagttgaagatatgtttgagcttagttattttaaccacctactttcacagactcatatcgatctatacaaccaaatgattggcggagtcaaacaagatagtttaaaaattcagggtttaaacgaaaaaatcaatctctatcgtcaagcaaacggcttgtcaaaacgtgaactgccaaatctcaaaccactacacaaacagatacttagtgatcgtgaaacactctcttggcttcctgaatcatttgaaagcgatgaggaacttatgcaaggtgtgcaagcatattttgagagtgaagtattagcttttgagtgctgcgatggtaaggtcaatcttttagagaaactgcctgagcttttgcaccaaacacaagattatgatttttcaaaagtttatttcaaaaacgatctagcacttacagctgcttcgcaagcgatttttaaagattatcgcattataaaagaagcactttgggaagtgaataaacctaaaaaatcaaaagatttagtggcggatgaagagaagttttttaacaagaaaaatagctattttagtattgagcaaatagatggtgccttaaatagtgcgcaactctccgctaacatgatgcactatttccaaagtgaatctacaaaggtaatcgagcaaattcaattgacttacaatgattggaagcgaaacagttcaaataaagaacttctaaaagcttttttagacgcgcttttatcgtatcaacgtcttttaaaaccgcttaatgctccaaacgatcttgaaaaagatgttgctttttatgcctacttcgatgcttattttacgagtttatgcggtgtagtcaagctttacgacaaagtaagaaactttatgaccaaaaagccgtattcacttgaaaaatttaaactcaattttgaaaactcgacactacttgatggttgggatgtcaataaagagtctgataatacggcaattttatttcgcaaagagggcttgtattatctaggtattatgaataaaaagtataacaaagtatttcgcaatatttctagttcacaagatgagggttaccaaaaaattgactataaactattaccaggtgcgaataaaatgcttccaaaagtctttttttctgataagaataaggaatattttaagccaaatgctaagttacttgagagatataaagcgggagagcataaaaaaggggataatttcgacttagatttttgtcacgaattaatagacttttttaaaacttcaatcgaaaaacatcaagattggaaacattttgcttatcagttttcaccgactgagagttacgaagatttaagcggtttttatagagaggttgaacagcaaggttataaaatcagttataaaaatattgcagcaagttttatcgatacattagttgcagaaggtaaactctattttttccagatctacaacaaagacttttctccctatagtaaaggtacgccaaatatgcacactctttattggcgtgcactttttgacgaaaagaatctagctgatgtgatctacaaacttaacgggcaagcggagatatttttccgtaaaaaatcgatcgagtactcccaagagaagctgcaaaaagggcatcaccacgaaatgcttaaagataagtttgcttatccaattatcaaagatcgtcgttttgcttttgataagttccagtttcatgtaccaataacgctcaactttaaagcagagggtaatgaaaacattacgccaaaaacatttgaatacattcgatctaatcccgacaacataaaagttataggtatagatcgtggtgagcgtcacttactctatctttcactcattgatgcagagggtaagatcgtagagcagtttacgctcaatcaaattattaatagctacaacgggaaagaccacgtcatagattatcatgccaaacttgacgcaaaagaaaaagaccgcgacaaagctcgaaaagagtggggaactgtcgaaaacatcaaagaactaaaagagggctatttaagccatgttatccataagatagcaactcttatcattgaacacggtgcagttgtagcgatggaagatctcaactttggctttaaacgtggacgtttcaaagttgaaaagcaagtctatcaaaaatttgaaaaagcacttatcgataagctgaactatcttgtcgataagaaaaaagagcctcataaacttggaggtcttttaaatgcgttgcaactcactagcaagtttcaaagttttgaaaaaatgggtaaacaaaacggctttttgttttatgtacctgcgtggaatacatccaaaatagatcctgttacgggttttgttaatctttttgatacccgttatgcaagtgtagaaaaatccaaagcattttttactaagtttcaatcaatttgctacaacgaagctaaagattacttcgagttagtatttgattataatgatttcacagaaaaagctaaagaaactcgaagcgagtggacactttgtacttatggtgaacgcattgtgagctttagaaacgcggagaaaaatcatcaatgggatagcaaaacaattcatcttacaacagagtttaaaaacctttttggtgagctgcatggtaatgatgtaaaagagtatattttagagcaaaattcagttgagttttttaagtcacttatctatttattaaaaattactttgcagatgcgtaactcaatcacgggtactgatatagactatcttgtctcacccgtcgcagatgaagcagggaatttttacgacagtcgtaaagccgatacatctttaccaaaagatgccgacgcaaacggtgcgtataatatcgctcgtaaaggtttaatgttgatgcatcgcatccaaaacgccgaagatctcaaaaaagtgaacttggcgatttcaaaccgtgactggctccgcaacgctcaaggactggataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 231 - DNA, 3831 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgctgagtaactttaccaaccagtatcagttatccaagaccttacgtttcgaattgaagccggtcggggatacgttgaaacacatcgagaagagtgggttgatcgcccaagacgaaatccgttcccaagagtaccaagaggttaaaacaatcatcgacaagtaccacaaagcctttatcgacgaagctttacaaaatgtggtgttatccaatcttgaggaatacgaagctcttttcttcgaacgtaatcgtgacgagaaggcgttcgagaaattgcaagctgtattgcgcaaagaaattgtagcacattttaaacaacatccccaatataagaccctttttaagaaggagttaatcaaagctgacctgaaaaattggcaagaactgagcgatgccgagaaagagttggtctcgcactttgataactttactacatacttcacgggtttccacgagaatcgcgccaatatgtacacggacgaggcgaagcacagcagtatcgcctaccgtattattcacgaaaatcttccaatctttcttactaacaagaaactgttcgaaaccattaagcagaaagctccacatttagcccaggaaacgcaggatgcattattggagtatttatccggagccatcgtggaagatatgtttgaacttagttatttcaaccacttgctgagtcagacgcatattgatctgtataatcagatgattggtggagttaagcaggatagtttaaagattcagggtctgaatgagaagattaatctttaccgtcaagcgaatgggctttcgaaacgtgaattgccgaatcttaaaccgctgcataaacaaattctgtcggatcgtgagacattatcttggcttccggaatctttcgagagtgacgaggagctgatgcaaggggtccaggcatatttcgaatctgaagttcttgcctttgaatgttgcgatgggaaggttaacttattagagaaactgccggagttgttacaccaaacacaggattatgattttagtaaagtttacttcaagaacgatttagcattgaccgctgcatcacaggcaatctttaaagactatcgtatcattaaggaggcgttgtgggaggttaataagccgaaaaaatctaaagacttagtcgctgacgaggaaaaattctttaataagaagaactcctacttctctattgagcagattgatggagcgttgaactcggcgcagctgagcgctaacatgatgcactattttcagagtgaatctacaaaggttattgaacaaatccaattgacttataacgactggaagcgtaacagtagcaacaaggaattgcttaaggcattccttgacgcactgctttcttatcagcgtcttttaaagcctttaaatgcccctaatgaccttgagaaggatgtggcattctatgcctactttgacgcctactttacaagcctgtgtggtgtcgttaaactgtacgacaaggtacgtaatttcatgaccaagaagccgtattcgttagagaaatttaagttgaattttgaaaactcgacgcttttagacggttgggatgtcaataaagaatccgacaacactgctattttatttcgtaaggaggggttgtactatctgggtattatgaataaaaagtacaataaggtctttcgtaatatttcatcatcccaagacgagggctatcaaaaaatcgactataaattacttccaggggccaataagatgctgccaaaagtgtttttcagtgataagaataaggagtatttcaagccaaacgccaagctgttggaacgttacaaagccggtgagcacaaaaaaggggataactttgatcttgacttctgtcacgaattgatcgactttttcaagacaagcatcgaaaagcaccaagactggaaacacttcgcctaccagtttagtcccaccgaatcgtacgaggacctttcaggtttttaccgtgaggtggaacaacaggggtacaaaatcagttacaaaaatatcgctgctagctttatcgatacgctggtggcagagggtaaactgtattttttccagatttacaacaaggatttcagtccatactcgaagggaactcccaacatgcacaccttatattggcgtgccttgttcgacgagaagaacttagcggatgtaatttataagttgaacggtcaggccgaaattttttttcgtaaaaagagcatcgaatattcgcaggaaaagttacaaaaggggcaccaccatgagatgttaaaggataagtttgcgtacccaattatcaaggatcgccgctttgcctttgacaagttccagtttcacgtgcctattacactgaattttaaagcggagggcaatgagaatatcactcctaagacgtttgaatatattcgctcgaatcctgataacattaaggtgattgggattgatcgcggcgagcgccacttactttacctgagtttaatcgacgcggaaggtaagattgttgaacagtttacattaaaccaaattatcaatagctacaatgggaaagaccatgtgattgactatcatgccaaattggatgcaaaggaaaaagatcgcgataaggctcgcaaggaatgggggactgtggaaaatatcaaggaattgaaagaaggttatttaagtcatgtaatccataaaatcgcaacccttattatcgagcatggcgctgttgtagcaatggaagaccttaattttggcttcaagcgcgggcgtttcaaagtggagaagcaggtgtatcagaaatttgagaaagctttaattgataaattgaattatttggttgataagaaaaaagagccgcataagttaggtggcttgttgaatgctttgcaattaacgtcaaaatttcagtctttcgaaaagatgggaaaacagaacggtttccttttctatgtgccagcctggaacacatcaaaaattgaccccgtcactgggtttgtaaacctgtttgatactcgctatgcaagcgttgaaaaaagtaaagctttcttcacgaagttccagtcaatttgctacaatgaggccaaggactactttgagttggtgttcgactacaatgactttacagagaaggctaaagaaacacgttcagagtggaccttatgtacatatggggagcgcatcgtgtcttttcgcaatgccgaaaaaaaccaccagtgggactccaaaacgattcatttgaccactgaatttaagaatttatttggggaattgcatgggaatgatgtaaaagagtatattctggaacaaaattctgttgaatttttcaaatcactgatttatcttcttaagattactcttcagatgcgcaattctatcacgggcaccgacattgactacttagtctctccggtcgcagatgaagctgggaatttctatgactcccgtaaggcggacacaagtcttccgaaagacgctgatgcgaacggtgcatacaatatcgcgcgcaaaggactgatgctgatgcaccgtatccagaacgcggaggacttgaagaaggtaaatttggccatctcaaatcgtgattggttgcgcaatgcccaaggtttagataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 232 - DNA, 3831 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtccaattttactaatcagtaccagcttagcaaaacacttcgcttcgagttaaagcctgttggtgacacgcttaaacacattgaaaagtcgggactgatcgcacaggatgagattcgctcacaggaatatcaggaggtaaagaccattatcgacaagtatcataaagccttcattgatgaagcattgcagaatgttgtgctgtcaaacctggaagaatatgaagcgttatttttcgaacgtaaccgcgacgaaaaggcgtttgagaaacttcaagccgtactgcgtaaggagatcgtggcccactttaagcagcaccctcagtataaaacactgttcaaaaaggagttgattaaagctgatctgaagaactggcaggagttatcggatgcagagaaagagcttgtaagccattttgacaacttcaccacgtatttcaccggctttcatgaaaaccgtgcgaatatgtataccgatgaagcaaaacattcttcaattgcttaccgcatcatccatgaaaaccttccaatttttcttacaaacaagaaactttttgaaacaattaaacaaaaggcgccgcacctggcgcaagaaacccaggatgccctgttagagtatttatcaggcgctattgtagaagatatgtttgagctgagttattttaaccacttgctgagtcaaacgcatatcgacctttataatcaaatgattgggggcgtgaaacaggattcgttaaaaatccaaggacttaacgagaagatcaatttgtaccgccaggcgaacgggctgtcaaaacgcgagttgccaaatttgaaaccgttgcataaacagattttatccgaccgcgagacgttgtcgtggttacccgaatcctttgagtccgacgaagaattgatgcaaggtgttcaagcttattttgaatcggaggtcctggcctttgaatgctgcgatgggaaggtaaacctgttggagaagttgccagaacttctgcaccaaacccaggactatgatttcagcaaggtatacttcaaaaacgacctggcgttaactgctgcctctcaggccattttcaaagattaccgcattattaaggaggccctgtgggaggtgaacaaaccaaaaaagagtaaggatttggtagcagatgaggaaaaattcttcaataagaaaaatagttatttcagcatcgaacaaattgacggtgccttaaactcagcccaattgtcggctaatatgatgcattattttcagtcggagtcaacgaaagtcatcgaacagattcagctgacctataatgattggaagcgcaactcatctaataaggaattgctgaaggccttcctggatgcgttactgtcgtaccagcgccttcttaagccgttaaacgccccgaatgacttagagaaggatgtagcgttctacgcctatttcgacgcgtatttcacatctctttgtggggttgtgaagttatatgataaagtccgtaactttatgaccaagaaaccatattcactggaaaagttcaagctgaattttgagaattcgacgttgttagatggctgggatgtgaacaaggagtctgacaacacagctattttatttcgcaaagagggtctttactatcttggaatcatgaataagaagtataacaaggtctttcgcaacatcagttccagtcaggacgagggataccagaagatcgattacaaattgttaccaggagctaataagatgttgcccaaagtgtttttctcggataagaacaaagaatacttcaagcctaacgccaaactgttggaacgctataaggcgggagaacataagaaaggtgataattttgacttagatttttgtcatgagcttatcgactttttcaagacatcgattgaaaaacatcaggattggaagcattttgcctaccagttctcccccacagagtcgtacgaggacctgagtgggttctatcgcgaagttgaacaacaaggatataaaatttcctacaaaaatatcgcggcgagctttatcgatacactggtcgcggaggggaaactttatttcttccagatctataacaaagacttctcaccatattctaagggcactccgaatatgcacaccttgtattggcgcgcactgttcgatgagaagaacttggctgatgtgatctataaactgaatggtcaggcggaaattttctttcgcaaaaaatccatcgaatattcgcaggaaaagcttcagaaaggtcaccaccatgaaatgttgaaggataagttcgcctaccccattattaaggatcgtcgttttgctttcgacaaattccaattccacgtgccaatcacattgaattttaaagctgagggcaatgagaacatcacgccaaaaacgtttgagtatatccgctcaaatccagataacatcaaggtgatcgggatcgatcgtggagagcgtcaccttctgtatttgtcgttgatcgacgcggagggcaagatcgtggagcaatttacgcttaaccagattattaatagctataatggtaaggaccacgtcattgattaccatgccaagctggatgctaaggagaaggaccgcgacaaggcgcgcaaggaatggggaacagtcgagaatatcaaagagctgaaagaggggtacttatctcatgtcattcacaaaatcgccacgttaattatcgagcatggggccgtggtagcaatggaggatctgaactttggcttcaaacgtggtcgctttaaagtggagaagcaggtataccaaaaatttgaaaaagcacttatcgacaaacttaactacctggtggacaaaaagaaagaaccacataaattaggcggcctgttgaacgccctgcaactgacctctaaatttcagtccttcgagaaaatgggtaaacagaatgggtttttgttctacgttcccgcgtggaacacatcgaaaattgatccagttacagggtttgtcaacctttttgatacacgctatgcaagcgtggaaaaaagtaaagccttcttcaccaagtttcagtccatctgctacaatgaagccaaagactattttgaactggtctttgattacaacgactttacggagaaagcaaaagaaacccgttccgagtggacgctttgcacgtatggggaacgcattgtgtcgtttcgtaacgctgagaagaaccaccagtgggactctaagacgatccaccttacgacggaattcaaaaatctttttggagaattacatggtaatgacgttaaagagtatattctggagcagaattcggttgaattctttaagagcctgatctatttgttgaagatcacccttcagatgcgcaattccattacaggtacagatattgactatttggtcagtccggtagcggacgaagcggggaatttttatgattcccgcaaagcagatactagtcttcctaaggacgctgatgcaaacggagcatataacatcgcccgtaaaggacttatgttaatgcatcgtattcaaaatgcagaggatcttaagaaagtgaatcttgccatcagtaatcgcgattggttacgcaacgcacagggcctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 233 - DNA, 3831 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgctgtcgaacttcacgaatcaatatcagcttagtaaaacgttacgcttcgagttaaaaccagttggtgatactttaaaacatattgagaagagtggcctgattgcacaggacgagattcgctctcaggagtaccaggaagttaagacaatcattgataaatatcacaaggctttcattgatgaggcattacaaaacgttgtactttctaacctggaagagtatgaggctttgttttttgaacgtaaccgcgacgagaaggctttcgagaagctgcaagcagtgttacgcaaagagatcgtcgcgcattttaagcaacacccgcagtataagacattgttcaagaaagaattaatcaaagcagacctgaaaaattggcaggagctttctgacgctgagaaggagctggtcagccactttgacaatttcactacatatttcacgggattccatgagaaccgtgctaacatgtacacggatgaagccaaacatagttctattgcttaccgtatcattcacgagaatctgccaatctttttgactaacaaaaagttgttcgagacgatcaagcaaaaggcaccgcacctggcgcaagagacccaagacgccttgttagagtatttgtccggagccatcgtcgaggacatgtttgaattgtcttatttcaatcatcttcttagtcaaacccacatcgatttgtataatcaaatgattggtggcgtaaagcaggattcgttaaaaatccagggtcttaatgaaaaaatcaacctgtatcgtcaagcgaacggattatctaaacgcgaacttccgaatctgaaaccacttcataagcaaatcttgtctgaccgcgagactctgagctggttacccgagtcgttcgagagcgatgaagagttgatgcagggggtacaggcatacttcgagtcggaggtcttagcatttgagtgctgcgacggaaaggtgaatcttctggaaaaattaccggagttgcttcaccaaactcaggactacgacttttccaaagtctatttcaaaaacgacttggctttgaccgcagcgagccaagcaattttcaaggattatcgtattatcaaggaggcactttgggaagtcaacaagcccaaaaagagtaaagacctggtcgctgatgaggaaaaatttttcaataagaagaatagctacttctctattgagcaaattgacggggctcttaactccgcgcagctttcagcgaacatgatgcattattttcagtcggagtctactaaagtaatcgagcagatccagttaacctacaacgactggaagcgcaacagtagtaacaaggagttacttaaggcgtttttggatgccttattatcctaccaacgtctgttaaagcccttaaacgcacctaacgacctggaaaaggatgtagcattctacgcttacttcgatgcttatttcaccagcctttgtggagttgtgaagctgtacgataaagtacgtaattttatgactaagaaaccgtacagtttggagaagtttaagctgaattttgaaaacagcacgctgttggatggttgggacgtcaacaaggagtcagacaacaccgccatcttatttcgcaaggaaggtttatattacctgggtattatgaataagaagtacaacaaagtattccgcaacattagttctagccaagatgagggctatcaaaagatcgattacaaactgttgccgggtgcaaacaaaatgcttccaaaggtctttttctctgataaaaacaaggaatactttaaacctaatgctaaacttttagaacgctacaaagccggcgagcacaaaaagggcgacaacttcgatttagacttctgccacgagttgatcgacttcttcaagacgtctattgagaaacaccaagattggaaacatttcgcatatcaattttcgcctactgagagttacgaagatctgtccggtttctaccgcgaagtcgagcaacagggctacaaaattagctacaaaaatattgcggcgtctttcatcgacacgctggtggctgaaggaaagctgtatttttttcaaatctataacaaggacttctctccatatagcaaaggtaccccgaacatgcatacactgtactggcgcgctcttttcgacgaaaagaaccttgcagacgtaatctacaagctgaacggtcaagctgaaatttttttccgtaagaagtcaatcgaatacagccaagaaaaattacagaaaggccaccatcatgaaatgttgaaagataaatttgcatacccaattatcaaagatcgtcgcttcgctttcgataaattccagttccatgttcccattaccctgaactttaaggcggaggggaacgaaaacattacccctaaaaccttcgagtacattcgttccaacccggacaatatcaaggttatcggcatcgaccgcggtgaacgccatctgttatatcttagcttgatcgatgcggaaggtaagattgtcgagcaattcacccttaaccagatcattaactcatataatggtaaggaccacgtaatcgactatcatgcaaagcttgacgccaaggagaaggatcgcgacaaggcgcgtaaagaatggggcacagttgagaacattaaggagctgaaagaaggttacttaagtcatgtcattcacaaaattgcaacactgatcatcgaacatggtgccgtggtcgcaatggaggacctgaattttggattcaagcgcggtcgctttaaggtggaaaaacaagtctatcaaaaatttgaaaaagctttaattgataaacttaactaccttgttgacaagaaaaaggagcctcacaaattaggtgggcttctgaatgcgctgcaattaacgtccaagtttcaatccttcgaaaaaatgggaaaacagaatggttttttattctatgtcccggcttggaacacaagtaaaattgatcctgttaccggcttcgtgaatttgttcgatacccgctacgcgagcgtagaaaaatctaaagcatttttcaccaaatttcagagtatctgctataatgaggcaaaggattattttgaattggttttcgactataatgattttacagaaaaagctaaagagactcgttctgagtggaccttgtgtacgtatggtgaacgtatcgtaagcttccgcaacgctgaaaaaaatcaccagtgggactctaaaacgattcatttgacaaccgagtttaaaaaccttttcggagaattgcacggtaacgacgttaaggaatatatcttagaacaaaattcggtcgaatttttcaagtcccttatctatcttttgaaaatcactcttcagatgcgcaattcgatcacagggaccgatatcgattatcttgtttcacctgtggctgacgaagcaggcaacttttacgacagccgcaaggccgacactagcttaccgaaagacgcagatgctaacggcgcctacaatatcgctcgcaaaggtcttatgcttatgcatcgcattcaaaacgctgaggacttaaagaaggttaatttagcgatttctaatcgtgactggttgcgtaacgcgcaagggctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 234 - DNA, 3831 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtctaacttcaccaaccagtatcaattatcgaaaactctgcgttttgagcttaaacccgtcggggatacgcttaaacatattgagaaaagcgggctgatcgcccaagacgaaatccgtagccaagagtatcaggaagtcaaaaccattatcgataagtaccacaaggcattcatcgacgaggcgttgcagaacgttgtactttctaatttggaagaatacgaggctctgttttttgagcgtaaccgcgacgaaaaggcgttcgagaagctgcaagcagtgttgcgtaaagaaattgtagcgcactttaaacaacacccccaatacaagactttgtttaaaaaagagcttattaaggccgatttaaaaaactggcaagagctgtccgacgctgagaaggaattggtgagtcatttcgacaactttacaacatatttcacgggattccacgaaaatcgcgcaaatatgtacacggatgaagctaagcatagcagcatcgcatatcgtatcattcacgaaaacttaccgatctttcttacgaacaaaaaacttttcgagacgattaagcaaaaggccccccaccttgcccaggagacacaggatgcgcttcttgagtatttgtcaggtgcaattgtcgaagacatgttcgaactgtcatattttaaccacttgttatcccaaactcatatcgacctttataatcagatgattggtggcgttaaacaagacagcttgaagatccaaggactgaatgaaaaaatcaatctttaccgccaggctaacggcttatcaaagcgcgaattgccaaacttgaaacccctgcacaaacagattctgagtgaccgtgagacactgtcttggttaccagagagcttcgagtcagacgaagagttaatgcagggtgtgcaggcctacttcgaatcagaggtcttagcctttgagtgttgtgatggtaaagtgaatctgctggaaaaattgccggaactgcttcaccagacccaagattacgactttagcaaagtctattttaaaaacgaccttgctttgacggcagcctcccaggcgatttttaaagattatcgtatcattaaggaggcgttatgggaggtgaataagcctaaaaaatccaaggatctggttgcagatgaggagaaattttttaataagaagaatagttatttcagtatcgagcagattgacggagcactgaatagtgctcaattgtccgccaatatgatgcactattttcaatcagagtcaaccaaggttattgaacagatccagttgacttataacgactggaagcgtaactcatcgaacaaagaacttttaaaagcattcttagacgcgcttttgtcttaccaacgtctgcttaaacctctgaatgcgcctaacgatttagaaaaagatgttgcattttatgcttacttcgatgcgtacttcacgtctttgtgtggagttgtaaaactttacgataaagtacgcaattttatgaccaagaaaccatatagcttggaaaaatttaagttaaactttgagaactccactcttttggacggatgggatgtaaacaaggaatcggataataccgcgattctttttcgtaaggaaggactttattatctgggcatcatgaataagaagtacaataaggtattccgtaatatctcttcttcacaagatgaaggttaccagaagattgattacaaattactgccaggtgccaataaaatgttgccgaaagtttttttttcggataaaaacaaggagtatttcaaaccgaacgcgaagttattagagcgctacaaagctggcgagcataaaaaaggggacaactttgatttagacttctgccatgagttaatcgacttcttcaagacatcaattgaaaaacaccaagactggaagcattttgcctatcagttctcgccaaccgagagttatgaggatctgtcagggttctatcgcgaggttgaacagcaagggtataagatctcttacaaaaatatcgcagcctcttttatcgatactcttgtcgcggaaggaaagctgtatttcttccagatttataataaggatttttcaccgtactctaagggtacacctaatatgcacacattgtactggcgcgctctgttcgatgagaaaaaccttgccgacgtaatctacaaattgaatgggcaagcagagatcttcttccgcaaaaagtcgattgaatattcgcaagaaaaattacaaaaaggtcatcatcacgagatgctgaaggataagtttgcatacccgatcattaaagatcgtcgctttgctttcgataaattccagttccacgtgccaatcacattgaatttcaaggctgagggaaatgagaatattacacctaaaacctttgagtatatccgttctaatcctgataacatcaaagtgatcggaattgaccgtggggaacgccatcttctgtacttatcattgattgatgcggagggcaagattgtggagcaatttaccttgaaccagattattaactcatacaacggaaaggatcatgtaatcgattaccatgcgaaattagatgcgaaggagaaggatcgcgacaaagcccgcaaagagtggggtacagttgaaaacattaaagagttgaaggagggttatctgagccatgtcatccataagatcgctactttgattattgagcatggagcggttgtggcaatggaagatttgaacttcggcttcaagcgtgggcgtttcaaggttgagaaacaagtttatcagaaatttgaaaaggcgcttattgataagttaaattacttggtagacaagaagaaggaaccccacaagctgggggggttattaaatgctttgcaacttacaagtaaattccagagcttcgagaaaatgggaaaacagaacgggtttttgttctatgtgcctgcctggaacacgtcaaagatcgaccctgtgaccgggttcgtaaaccttttcgacactcgttatgcaagcgttgagaagagtaaggccttttttacgaaatttcagtcgatctgttacaacgaagcgaaggactactttgaactggtctttgactataatgactttactgaaaaggccaaggaaacccgctcagaatggacgttatgtacatacggcgagcgtattgtgagctttcgtaacgcggagaagaaccatcaatgggacagcaagaccattcatcttacaacggaatttaagaatctgtttggagagttacacggcaacgatgtgaaggagtatatccttgagcagaactcggtggaattctttaagtcccttatctatttgcttaaaatcactctgcagatgcgtaattctattacaggaactgatattgattacttagtgtcgccggtagctgatgaagccgggaatttctatgacagccgtaaagcggacaccagcttgcccaaggatgcggacgccaatggcgcgtataatattgcacgcaaaggactgatgttaatgcaccgcattcagaacgcagaggacctgaagaaggtaaatcttgcgatctccaatcgcgactggttacgtaacgcccagggccttgataagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 235 - DNA, 3930 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtcaaattttacaaatcagtaccaactttcaaaaaccttgcgttttgaactcaaacctgtaggtgatacacttaagcatatagagaaaagtggcttgatagcacaagatgaaatacgctcacaagagtatcaagaagtaaaaacgattatcgataaataccacaaagcttttattgatgaagcacttcaaaatgttgtgcttagtaatcttgaagagtacgaagcactttttttcgagagaaatcgcgatgaaaaagcttttgaaaaattgcaagctgtattgcgtaaagagatagttgcacattttaagcaacaccctcaatacaaaacactttttaaaaaagagcttattaaagctgatttgaaaaattggcaagaactaagcgacgcagaaaaagagcttgtaagccactttgataacttcacaacctactttacaggttttcatgaaaatcgtgccaatatgtacacagatgaagcgaaacactcttctatcgcttaccgtattatccacgaaaatttgcctatttttttaacaaataaaaaactttttgaaacaatcaagcaaaaagcaccacaccttgcacaagaaacgcaagatgccttgcttgaatatttaagtggtgcaatagttgaagatatgtttgagcttagttattttaaccacctactttcacagactcatatcgatctatacaaccaaatgattggcggagtcaaacaagatagtttaaaaattcagggtttaaacgaaaaaatcaatctctatcgtcaagcaaacggcttgtcaaaacgtgaactgccaaatctcaaaccactacacaaacagatacttagtgatcgtgaaacactctcttggcttcctgaatcatttgaaagcgatgaggaacttatgcaaggtgtgcaagcatattttgagagtgaagtattagcttttgagtgctgcgatggtaaggtcaatcttttagagaaactgcctgagcttttgcaccaaacacaagattatgatttttcaaaagtttatttcaaaaacgatctagcacttacagctgcttcgcaagcgatttttaaagattatcgcattataaaagaagcactttgggaagtgaataaacctaaaaaatcaaaagatttagtggcggatgaagagaagttttttaacaagaaaaatagctattttagtattgagcaaatagatggtgccttaaatagtgcgcaactctccgctaacatgatgcactatttccaaagtgaatctacaaaggtaatcgagcaaattcaattgacttacaatgattggaagcgaaacagttcaaataaagaacttctaaaagcttttttagacgcgcttttatcgtatcaacgtcttttaaaaccgcttaatgctccaaacgatcttgaaaaagatgttgctttttatgcctacttcgatgcttattttacgagtttatgcggtgtagtcaagctttacgacaaagtaagaaactttatgaccaaaaagccgtattcacttgaaaaatttaaactcaattttgaaaactcgacactacttgatggttgggatgtcaataaagagtctgataatacggcaattttatttcgcaaagagggcttgtattatctaggtattatgaataaaaagtataacaaagtatttcgcaatatttctagttcacaagatgagggttaccaaaaaattgactataaactattaccaggtgcgaataaaatgcttccaaaagtctttttttctgataagaataaggaatattttaagccaaatgctaagttacttgagagatataaagcgggagagcataaaaaaggggataatttcgacttagatttttgtcacgaattaatagacttttttaaaacttcaatcgaaaaacatcaagattggaaacattttgcttatcagttttcaccgactgagagttacgaagatttaagcggtttttatagagaggttgaacagcaaggttataaaatcagttataaaaatattgcagcaagttttatcgatacattagttgcagaaggtaaactctattttttccagatctacaacaaagacttttctccctatagtaaaggtacgccaaatatgcacactctttattggcgtgcactttttgacgaaaagaatctagctgatgtgatctacaaacttaacgggcaagcggagatatttttccgtaaaaaatcgatcgagtactcccaagagaagctgcaaaaagggcatcaccacgaaatgcttaaagataagtttgcttatccaattatcaaagatcgtcgttttgcttttgataagttccagtttcatgtaccaataacgctcaactttaaagcagagggtaatgaaaacattacgccaaaaacatttgaatacattcgatctaatcccgacaacataaaagttataggtatagatcgtggtgagcgtcacttactctatctttcactcattgatgcagagggtaagatcgtagagcagtttacgctcaatcaaattattaatagctacaacgggaaagaccacgtcatagattatcatgccaaacttgacgcaaaagaaaaagaccgcgacaaagctcgaaaagagtggggaactgtcgaaaacatcaaagaactaaaagagggctatttaagccatgttatccataagatagcaactcttatcattgaacacggtgcagttgtagcgatggaagatctcaactttggctttaaacgtggacgtttcaaagttgaaaagcaagtctatcaaaaatttgaaaaagcacttatcgataagctgaactatcttgtcgataagaaaaaagagcctcataaacttggaggtcttttaaatgcgttgcaactcactagcaagtttcaaagttttgaaaaaatgggtaaacaaaacggctttttgttttatgtacctgcgtggaatacatccaaaatagatcctgttacgggttttgttaatctttttgatacccgttatgcaagtgtagaaaaatccaaagcattttttactaagtttcaatcaatttgctacaacgaagctaaagattacttcgagttagtatttgattataatgatttcacagaaaaagctaaagaaactcgaagcgagtggacactttgtacttatggtgaacgcattgtgagctttagaaacgcggagaaaaatcatcaatgggatagcaaaacaattcatcttacaacagagtttaaaaacctttttggtgagctgcatggtaatgatgtaaaagagtatattttagagcaaaattcagttgagttttttaagtcacttatctatttattaaaaattactttgcagatgcgtaactcaatcacgggtactgatatagactatcttgtctcacccgtcgcagatgaagcagggaatttttacgacagtcgtaaagccgatacatctttaccaaaagatgccgacgcaaacggtgcgtataatatcgctcgtaaaggtttaatgttgatgcatcgcatccaaaacgccgaagatctcaaaaaagtgaacttggcgatttcaaaccgtgactggctccgcaacgctcaaggactggataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 236 - DNA, 3930 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgctgagtaactttaccaaccagtatcagttatccaagaccttacgtttcgaattgaagccggtcggggatacgttgaaacacatcgagaagagtgggttgatcgcccaagacgaaatccgttcccaagagtaccaagaggttaaaacaatcatcgacaagtaccacaaagcctttatcgacgaagctttacaaaatgtggtgttatccaatcttgaggaatacgaagctcttttcttcgaacgtaatcgtgacgagaaggcgttcgagaaattgcaagctgtattgcgcaaagaaattgtagcacattttaaacaacatccccaatataagaccctttttaagaaggagttaatcaaagctgacctgaaaaattggcaagaactgagcgatgccgagaaagagttggtctcgcactttgataactttactacatacttcacgggtttccacgagaatcgcgccaatatgtacacggacgaggcgaagcacagcagtatcgcctaccgtattattcacgaaaatcttccaatctttcttactaacaagaaactgttcgaaaccattaagcagaaagctccacatttagcccaggaaacgcaggatgcattattggagtatttatccggagccatcgtggaagatatgtttgaacttagttatttcaaccacttgctgagtcagacgcatattgatctgtataatcagatgattggtggagttaagcaggatagtttaaagattcagggtctgaatgagaagattaatctttaccgtcaagcgaatgggctttcgaaacgtgaattgccgaatcttaaaccgctgcataaacaaattctgtcggatcgtgagacattatcttggcttccggaatctttcgagagtgacgaggagctgatgcaaggggtccaggcatatttcgaatctgaagttcttgcctttgaatgttgcgatgggaaggttaacttattagagaaactgccggagttgttacaccaaacacaggattatgattttagtaaagtttacttcaagaacgatttagcattgaccgctgcatcacaggcaatctttaaagactatcgtatcattaaggaggcgttgtgggaggttaataagccgaaaaaatctaaagacttagtcgctgacgaggaaaaattctttaataagaagaactcctacttctctattgagcagattgatggagcgttgaactcggcgcagctgagcgctaacatgatgcactattttcagagtgaatctacaaaggttattgaacaaatccaattgacttataacgactggaagcgtaacagtagcaacaaggaattgcttaaggcattccttgacgcactgctttcttatcagcgtcttttaaagcctttaaatgcccctaatgaccttgagaaggatgtggcattctatgcctactttgacgcctactttacaagcctgtgtggtgtcgttaaactgtacgacaaggtacgtaatttcatgaccaagaagccgtattcgttagagaaatttaagttgaattttgaaaactcgacgcttttagacggttgggatgtcaataaagaatccgacaacactgctattttatttcgtaaggaggggttgtactatctgggtattatgaataaaaagtacaataaggtctttcgtaatatttcatcatcccaagacgagggctatcaaaaaatcgactataaattacttccaggggccaataagatgctgccaaaagtgtttttcagtgataagaataaggagtatttcaagccaaacgccaagctgttggaacgttacaaagccggtgagcacaaaaaaggggataactttgatcttgacttctgtcacgaattgatcgactttttcaagacaagcatcgaaaagcaccaagactggaaacacttcgcctaccagtttagtcccaccgaatcgtacgaggacctttcaggtttttaccgtgaggtggaacaacaggggtacaaaatcagttacaaaaatatcgctgctagctttatcgatacgctggtggcagagggtaaactgtattttttccagatttacaacaaggatttcagtccatactcgaagggaactcccaacatgcacaccttatattggcgtgccttgttcgacgagaagaacttagcggatgtaatttataagttgaacggtcaggccgaaattttttttcgtaaaaagagcatcgaatattcgcaggaaaagttacaaaaggggcaccaccatgagatgttaaaggataagtttgcgtacccaattatcaaggatcgccgctttgcctttgacaagttccagtttcacgtgcctattacactgaattttaaagcggagggcaatgagaatatcactcctaagacgtttgaatatattcgctcgaatcctgataacattaaggtgattgggattgatcgcggcgagcgccacttactttacctgagtttaatcgacgcggaaggtaagattgttgaacagtttacattaaaccaaattatcaatagctacaatgggaaagaccatgtgattgactatcatgccaaattggatgcaaaggaaaaagatcgcgataaggctcgcaaggaatgggggactgtggaaaatatcaaggaattgaaagaaggttatttaagtcatgtaatccataaaatcgcaacccttattatcgagcatggcgctgttgtagcaatggaagaccttaattttggcttcaagcgcgggcgtttcaaagtggagaagcaggtgtatcagaaatttgagaaagctttaattgataaattgaattatttggttgataagaaaaaagagccgcataagttaggtggcttgttgaatgctttgcaattaacgtcaaaatttcagtctttcgaaaagatgggaaaacagaacggtttccttttctatgtgccagcctggaacacatcaaaaattgaccccgtcactgggtttgtaaacctgtttgatactcgctatgcaagcgttgaaaaaagtaaagctttcttcacgaagttccagtcaatttgctacaatgaggccaaggactactttgagttggtgttcgactacaatgactttacagagaaggctaaagaaacacgttcagagtggaccttatgtacatatggggagcgcatcgtgtcttttcgcaatgccgaaaaaaaccaccagtgggactccaaaacgattcatttgaccactgaatttaagaatttatttggggaattgcatgggaatgatgtaaaagagtatattctggaacaaaattctgttgaatttttcaaatcactgatttatcttcttaagattactcttcagatgcgcaattctatcacgggcaccgacattgactacttagtctctccggtcgcagatgaagctgggaatttctatgactcccgtaaggcggacacaagtcttccgaaagacgctgatgcgaacggtgcatacaatatcgcgcgcaaaggactgatgctgatgcaccgtatccagaacgcggaggacttgaagaaggtaaatttggccatctcaaatcgtgattggttgcgcaatgcccaaggtttagataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 237 - DNA, 3930 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtccaattttactaatcagtaccagcttagcaaaacacttcgcttcgagttaaagcctgttggtgacacgcttaaacacattgaaaagtcgggactgatcgcacaggatgagattcgctcacaggaatatcaggaggtaaagaccattatcgacaagtatcataaagccttcattgatgaagcattgcagaatgttgtgctgtcaaacctggaagaatatgaagcgttatttttcgaacgtaaccgcgacgaaaaggcgtttgagaaacttcaagccgtactgcgtaaggagatcgtggcccactttaagcagcaccctcagtataaaacactgttcaaaaaggagttgattaaagctgatctgaagaactggcaggagttatcggatgcagagaaagagcttgtaagccattttgacaacttcaccacgtatttcaccggctttcatgaaaaccgtgcgaatatgtataccgatgaagcaaaacattcttcaattgcttaccgcatcatccatgaaaaccttccaatttttcttacaaacaagaaactttttgaaacaattaaacaaaaggcgccgcacctggcgcaagaaacccaggatgccctgttagagtatttatcaggcgctattgtagaagatatgtttgagctgagttattttaaccacttgctgagtcaaacgcatatcgacctttataatcaaatgattgggggcgtgaaacaggattcgttaaaaatccaaggacttaacgagaagatcaatttgtaccgccaggcgaacgggctgtcaaaacgcgagttgccaaatttgaaaccgttgcataaacagattttatccgaccgcgagacgttgtcgtggttacccgaatcctttgagtccgacgaagaattgatgcaaggtgttcaagcttattttgaatcggaggtcctggcctttgaatgctgcgatgggaaggtaaacctgttggagaagttgccagaacttctgcaccaaacccaggactatgatttcagcaaggtatacttcaaaaacgacctggcgttaactgctgcctctcaggccattttcaaagattaccgcattattaaggaggccctgtgggaggtgaacaaaccaaaaaagagtaaggatttggtagcagatgaggaaaaattcttcaataagaaaaatagttatttcagcatcgaacaaattgacggtgccttaaactcagcccaattgtcggctaatatgatgcattattttcagtcggagtcaacgaaagtcatcgaacagattcagctgacctataatgattggaagcgcaactcatctaataaggaattgctgaaggccttcctggatgcgttactgtcgtaccagcgccttcttaagccgttaaacgccccgaatgacttagagaaggatgtagcgttctacgcctatttcgacgcgtatttcacatctctttgtggggttgtgaagttatatgataaagtccgtaactttatgaccaagaaaccatattcactggaaaagttcaagctgaattttgagaattcgacgttgttagatggctgggatgtgaacaaggagtctgacaacacagctattttatttcgcaaagagggtctttactatcttggaatcatgaataagaagtataacaaggtctttcgcaacatcagttccagtcaggacgagggataccagaagatcgattacaaattgttaccaggagctaataagatgttgcccaaagtgtttttctcggataagaacaaagaatacttcaagcctaacgccaaactgttggaacgctataaggcgggagaacataagaaaggtgataattttgacttagatttttgtcatgagcttatcgactttttcaagacatcgattgaaaaacatcaggattggaagcattttgcctaccagttctcccccacagagtcgtacgaggacctgagtgggttctatcgcgaagttgaacaacaaggatataaaatttcctacaaaaatatcgcggcgagctttatcgatacactggtcgcggaggggaaactttatttcttccagatctataacaaagacttctcaccatattctaagggcactccgaatatgcacaccttgtattggcgcgcactgttcgatgagaagaacttggctgatgtgatctataaactgaatggtcaggcggaaattttctttcgcaaaaaatccatcgaatattcgcaggaaaagcttcagaaaggtcaccaccatgaaatgttgaaggataagttcgcctaccccattattaaggatcgtcgttttgctttcgacaaattccaattccacgtgccaatcacattgaattttaaagctgagggcaatgagaacatcacgccaaaaacgtttgagtatatccgctcaaatccagataacatcaaggtgatcgggatcgatcgtggagagcgtcaccttctgtatttgtcgttgatcgacgcggagggcaagatcgtggagcaatttacgcttaaccagattattaatagctataatggtaaggaccacgtcattgattaccatgccaagctggatgctaaggagaaggaccgcgacaaggcgcgcaaggaatggggaacagtcgagaatatcaaagagctgaaagaggggtacttatctcatgtcattcacaaaatcgccacgttaattatcgagcatggggccgtggtagcaatggaggatctgaactttggcttcaaacgtggtcgctttaaagtggagaagcaggtataccaaaaatttgaaaaagcacttatcgacaaacttaactacctggtggacaaaaagaaagaaccacataaattaggcggcctgttgaacgccctgcaactgacctctaaatttcagtccttcgagaaaatgggtaaacagaatgggtttttgttctacgttcccgcgtggaacacatcgaaaattgatccagttacagggtttgtcaacctttttgatacacgctatgcaagcgtggaaaaaagtaaagccttcttcaccaagtttcagtccatctgctacaatgaagccaaagactattttgaactggtctttgattacaacgactttacggagaaagcaaaagaaacccgttccgagtggacgctttgcacgtatggggaacgcattgtgtcgtttcgtaacgctgagaagaaccaccagtgggactctaagacgatccaccttacgacggaattcaaaaatctttttggagaattacatggtaatgacgttaaagagtatattctggagcagaattcggttgaattctttaagagcctgatctatttgttgaagatcacccttcagatgcgcaattccattacaggtacagatattgactatttggtcagtccggtagcggacgaagcggggaatttttatgattcccgcaaagcagatactagtcttcctaaggacgctgatgcaaacggagcatataacatcgcccgtaaaggacttatgttaatgcatcgtattcaaaatgcagaggatcttaagaaagtgaatcttgccatcagtaatcgcgattggttacgcaacgcacagggcctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 238 - DNA, 3930 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgctgtcgaacttcacgaatcaatatcagcttagtaaaacgttacgcttcgagttaaaaccagttggtgatactttaaaacatattgagaagagtggcctgattgcacaggacgagattcgctctcaggagtaccaggaagttaagacaatcattgataaatatcacaaggctttcattgatgaggcattacaaaacgttgtactttctaacctggaagagtatgaggctttgttttttgaacgtaaccgcgacgagaaggctttcgagaagctgcaagcagtgttacgcaaagagatcgtcgcgcattttaagcaacacccgcagtataagacattgttcaagaaagaattaatcaaagcagacctgaaaaattggcaggagctttctgacgctgagaaggagctggtcagccactttgacaatttcactacatatttcacgggattccatgagaaccgtgctaacatgtacacggatgaagccaaacatagttctattgcttaccgtatcattcacgagaatctgccaatctttttgactaacaaaaagttgttcgagacgatcaagcaaaaggcaccgcacctggcgcaagagacccaagacgccttgttagagtatttgtccggagccatcgtcgaggacatgtttgaattgtcttatttcaatcatcttcttagtcaaacccacatcgatttgtataatcaaatgattggtggcgtaaagcaggattcgttaaaaatccagggtcttaatgaaaaaatcaacctgtatcgtcaagcgaacggattatctaaacgcgaacttccgaatctgaaaccacttcataagcaaatcttgtctgaccgcgagactctgagctggttacccgagtcgttcgagagcgatgaagagttgatgcagggggtacaggcatacttcgagtcggaggtcttagcatttgagtgctgcgacggaaaggtgaatcttctggaaaaattaccggagttgcttcaccaaactcaggactacgacttttccaaagtctatttcaaaaacgacttggctttgaccgcagcgagccaagcaattttcaaggattatcgtattatcaaggaggcactttgggaagtcaacaagcccaaaaagagtaaagacctggtcgctgatgaggaaaaatttttcaataagaagaatagctacttctctattgagcaaattgacggggctcttaactccgcgcagctttcagcgaacatgatgcattattttcagtcggagtctactaaagtaatcgagcagatccagttaacctacaacgactggaagcgcaacagtagtaacaaggagttacttaaggcgtttttggatgccttattatcctaccaacgtctgttaaagcccttaaacgcacctaacgacctggaaaaggatgtagcattctacgcttacttcgatgcttatttcaccagcctttgtggagttgtgaagctgtacgataaagtacgtaattttatgactaagaaaccgtacagtttggagaagtttaagctgaattttgaaaacagcacgctgttggatggttgggacgtcaacaaggagtcagacaacaccgccatcttatttcgcaaggaaggtttatattacctgggtattatgaataagaagtacaacaaagtattccgcaacattagttctagccaagatgagggctatcaaaagatcgattacaaactgttgccgggtgcaaacaaaatgcttccaaaggtctttttctctgataaaaacaaggaatactttaaacctaatgctaaacttttagaacgctacaaagccggcgagcacaaaaagggcgacaacttcgatttagacttctgccacgagttgatcgacttcttcaagacgtctattgagaaacaccaagattggaaacatttcgcatatcaattttcgcctactgagagttacgaagatctgtccggtttctaccgcgaagtcgagcaacagggctacaaaattagctacaaaaatattgcggcgtctttcatcgacacgctggtggctgaaggaaagctgtatttttttcaaatctataacaaggacttctctccatatagcaaaggtaccccgaacatgcatacactgtactggcgcgctcttttcgacgaaaagaaccttgcagacgtaatctacaagctgaacggtcaagctgaaatttttttccgtaagaagtcaatcgaatacagccaagaaaaattacagaaaggccaccatcatgaaatgttgaaagataaatttgcatacccaattatcaaagatcgtcgcttcgctttcgataaattccagttccatgttcccattaccctgaactttaaggcggaggggaacgaaaacattacccctaaaaccttcgagtacattcgttccaacccggacaatatcaaggttatcggcatcgaccgcggtgaacgccatctgttatatcttagcttgatcgatgcggaaggtaagattgtcgagcaattcacccttaaccagatcattaactcatataatggtaaggaccacgtaatcgactatcatgcaaagcttgacgccaaggagaaggatcgcgacaaggcgcgtaaagaatggggcacagttgagaacattaaggagctgaaagaaggttacttaagtcatgtcattcacaaaattgcaacactgatcatcgaacatggtgccgtggtcgcaatggaggacctgaattttggattcaagcgcggtcgctttaaggtggaaaaacaagtctatcaaaaatttgaaaaagctttaattgataaacttaactaccttgttgacaagaaaaaggagcctcacaaattaggtgggcttctgaatgcgctgcaattaacgtccaagtttcaatccttcgaaaaaatgggaaaacagaatggttttttattctatgtcccggcttggaacacaagtaaaattgatcctgttaccggcttcgtgaatttgttcgatacccgctacgcgagcgtagaaaaatctaaagcatttttcaccaaatttcagagtatctgctataatgaggcaaaggattattttgaattggttttcgactataatgattttacagaaaaagctaaagagactcgttctgagtggaccttgtgtacgtatggtgaacgtatcgtaagcttccgcaacgctgaaaaaaatcaccagtgggactctaaaacgattcatttgacaaccgagtttaaaaaccttttcggagaattgcacggtaacgacgttaaggaatatatcttagaacaaaattcggtcgaatttttcaagtcccttatctatcttttgaaaatcactcttcagatgcgcaattcgatcacagggaccgatatcgattatcttgtttcacctgtggctgacgaagcaggcaacttttacgacagccgcaaggccgacactagcttaccgaaagacgcagatgctaacggcgcctacaatatcgctcgcaaaggtcttatgcttatgcatcgcattcaaaacgctgaggacttaaagaaggttaatttagcgatttctaatcgtgactggttgcgtaacgcgcaagggctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 239 - DNA, 3930 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgttgtctaacttcaccaaccagtatcaattatcgaaaactctgcgttttgagcttaaacccgtcggggatacgcttaaacatattgagaaaagcgggctgatcgcccaagacgaaatccgtagccaagagtatcaggaagtcaaaaccattatcgataagtaccacaaggcattcatcgacgaggcgttgcagaacgttgtactttctaatttggaagaatacgaggctctgttttttgagcgtaaccgcgacgaaaaggcgttcgagaagctgcaagcagtgttgcgtaaagaaattgtagcgcactttaaacaacacccccaatacaagactttgtttaaaaaagagcttattaaggccgatttaaaaaactggcaagagctgtccgacgctgagaaggaattggtgagtcatttcgacaactttacaacatatttcacgggattccacgaaaatcgcgcaaatatgtacacggatgaagctaagcatagcagcatcgcatatcgtatcattcacgaaaacttaccgatctttcttacgaacaaaaaacttttcgagacgattaagcaaaaggccccccaccttgcccaggagacacaggatgcgcttcttgagtatttgtcaggtgcaattgtcgaagacatgttcgaactgtcatattttaaccacttgttatcccaaactcatatcgacctttataatcagatgattggtggcgttaaacaagacagcttgaagatccaaggactgaatgaaaaaatcaatctttaccgccaggctaacggcttatcaaagcgcgaattgccaaacttgaaacccctgcacaaacagattctgagtgaccgtgagacactgtcttggttaccagagagcttcgagtcagacgaagagttaatgcagggtgtgcaggcctacttcgaatcagaggtcttagcctttgagtgttgtgatggtaaagtgaatctgctggaaaaattgccggaactgcttcaccagacccaagattacgactttagcaaagtctattttaaaaacgaccttgctttgacggcagcctcccaggcgatttttaaagattatcgtatcattaaggaggcgttatgggaggtgaataagcctaaaaaatccaaggatctggttgcagatgaggagaaattttttaataagaagaatagttatttcagtatcgagcagattgacggagcactgaatagtgctcaattgtccgccaatatgatgcactattttcaatcagagtcaaccaaggttattgaacagatccagttgacttataacgactggaagcgtaactcatcgaacaaagaacttttaaaagcattcttagacgcgcttttgtcttaccaacgtctgcttaaacctctgaatgcgcctaacgatttagaaaaagatgttgcattttatgcttacttcgatgcgtacttcacgtctttgtgtggagttgtaaaactttacgataaagtacgcaattttatgaccaagaaaccatatagcttggaaaaatttaagttaaactttgagaactccactcttttggacggatgggatgtaaacaaggaatcggataataccgcgattctttttcgtaaggaaggactttattatctgggcatcatgaataagaagtacaataaggtattccgtaatatctcttcttcacaagatgaaggttaccagaagattgattacaaattactgccaggtgccaataaaatgttgccgaaagtttttttttcggataaaaacaaggagtatttcaaaccgaacgcgaagttattagagcgctacaaagctggcgagcataaaaaaggggacaactttgatttagacttctgccatgagttaatcgacttcttcaagacatcaattgaaaaacaccaagactggaagcattttgcctatcagttctcgccaaccgagagttatgaggatctgtcagggttctatcgcgaggttgaacagcaagggtataagatctcttacaaaaatatcgcagcctcttttatcgatactcttgtcgcggaaggaaagctgtatttcttccagatttataataaggatttttcaccgtactctaagggtacacctaatatgcacacattgtactggcgcgctctgttcgatgagaaaaaccttgccgacgtaatctacaaattgaatgggcaagcagagatcttcttccgcaaaaagtcgattgaatattcgcaagaaaaattacaaaaaggtcatcatcacgagatgctgaaggataagtttgcatacccgatcattaaagatcgtcgctttgctttcgataaattccagttccacgtgccaatcacattgaatttcaaggctgagggaaatgagaatattacacctaaaacctttgagtatatccgttctaatcctgataacatcaaagtgatcggaattgaccgtggggaacgccatcttctgtacttatcattgattgatgcggagggcaagattgtggagcaatttaccttgaaccagattattaactcatacaacggaaaggatcatgtaatcgattaccatgcgaaattagatgcgaaggagaaggatcgcgacaaagcccgcaaagagtggggtacagttgaaaacattaaagagttgaaggagggttatctgagccatgtcatccataagatcgctactttgattattgagcatggagcggttgtggcaatggaagatttgaacttcggcttcaagcgtgggcgtttcaaggttgagaaacaagtttatcagaaatttgaaaaggcgcttattgataagttaaattacttggtagacaagaagaaggaaccccacaagctgggggggttattaaatgctttgcaacttacaagtaaattccagagcttcgagaaaatgggaaaacagaacgggtttttgttctatgtgcctgcctggaacacgtcaaagatcgaccctgtgaccgggttcgtaaaccttttcgacactcgttatgcaagcgttgagaagagtaaggccttttttacgaaatttcagtcgatctgttacaacgaagcgaaggactactttgaactggtctttgactataatgactttactgaaaaggccaaggaaacccgctcagaatggacgttatgtacatacggcgagcgtattgtgagctttcgtaacgcggagaagaaccatcaatgggacagcaagaccattcatcttacaacggaatttaagaatctgtttggagagttacacggcaacgatgtgaaggagtatatccttgagcagaactcggtggaattctttaagtcccttatctatttgcttaaaatcactctgcagatgcgtaattctattacaggaactgatattgattacttagtgtcgccggtagctgatgaagccgggaatttctatgacagccgtaaagcggacaccagcttgcccaaggatgcggacgccaatggcgcgtataatattgcacgcaaaggactgatgttaatgcaccgcattcagaacgcagaggacctgaagaaggtaaatcttgcgatctccaatcgcgactggttacgtaacgcccagggccttgataagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 240 - DNA, 3924 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgttgtcaaattttacaaatcagtaccaactttcaaaaaccttgcgttttgaactcaaacctgtaggtgatacacttaagcatatagagaaaagtggcttgatagcacaagatgaaatacgctcacaagagtatcaagaagtaaaaacgattatcgataaataccacaaagcttttattgatgaagcacttcaaaatgttgtgcttagtaatcttgaagagtacgaagcactttttttcgagagaaatcgcgatgaaaaagcttttgaaaaattgcaagctgtattgcgtaaagagatagttgcacattttaagcaacaccctcaatacaaaacactttttaaaaaagagcttattaaagctgatttgaaaaattggcaagaactaagcgacgcagaaaaagagcttgtaagccactttgataacttcacaacctactttacaggttttcatgaaaatcgtgccaatatgtacacagatgaagcgaaacactcttctatcgcttaccgtattatccacgaaaatttgcctatttttttaacaaataaaaaactttttgaaacaatcaagcaaaaagcaccacaccttgcacaagaaacgcaagatgccttgcttgaatatttaagtggtgcaatagttgaagatatgtttgagcttagttattttaaccacctactttcacagactcatatcgatctatacaaccaaatgattggcggagtcaaacaagatagtttaaaaattcagggtttaaacgaaaaaatcaatctctatcgtcaagcaaacggcttgtcaaaacgtgaactgccaaatctcaaaccactacacaaacagatacttagtgatcgtgaaacactctcttggcttcctgaatcatttgaaagcgatgaggaacttatgcaaggtgtgcaagcatattttgagagtgaagtattagcttttgagtgctgcgatggtaaggtcaatcttttagagaaactgcctgagcttttgcaccaaacacaagattatgatttttcaaaagtttatttcaaaaacgatctagcacttacagctgcttcgcaagcgatttttaaagattatcgcattataaaagaagcactttgggaagtgaataaacctaaaaaatcaaaagatttagtggcggatgaagagaagttttttaacaagaaaaatagctattttagtattgagcaaatagatggtgccttaaatagtgcgcaactctccgctaacatgatgcactatttccaaagtgaatctacaaaggtaatcgagcaaattcaattgacttacaatgattggaagcgaaacagttcaaataaagaacttctaaaagcttttttagacgcgcttttatcgtatcaacgtcttttaaaaccgcttaatgctccaaacgatcttgaaaaagatgttgctttttatgcctacttcgatgcttattttacgagtttatgcggtgtagtcaagctttacgacaaagtaagaaactttatgaccaaaaagccgtattcacttgaaaaatttaaactcaattttgaaaactcgacactacttgatggttgggatgtcaataaagagtctgataatacggcaattttatttcgcaaagagggcttgtattatctaggtattatgaataaaaagtataacaaagtatttcgcaatatttctagttcacaagatgagggttaccaaaaaattgactataaactattaccaggtgcgaataaaatgcttccaaaagtctttttttctgataagaataaggaatattttaagccaaatgctaagttacttgagagatataaagcgggagagcataaaaaaggggataatttcgacttagatttttgtcacgaattaatagacttttttaaaacttcaatcgaaaaacatcaagattggaaacattttgcttatcagttttcaccgactgagagttacgaagatttaagcggtttttatagagaggttgaacagcaaggttataaaatcagttataaaaatattgcagcaagttttatcgatacattagttgcagaaggtaaactctattttttccagatctacaacaaagacttttctccctatagtaaaggtacgccaaatatgcacactctttattggcgtgcactttttgacgaaaagaatctagctgatgtgatctacaaacttaacgggcaagcggagatatttttccgtaaaaaatcgatcgagtactcccaagagaagctgcaaaaagggcatcaccacgaaatgcttaaagataagtttgcttatccaattatcaaagatcgtcgttttgcttttgataagttccagtttcatgtaccaataacgctcaactttaaagcagagggtaatgaaaacattacgccaaaaacatttgaatacattcgatctaatcccgacaacataaaagttataggtatagatcgtggtgagcgtcacttactctatctttcactcattgatgcagagggtaagatcgtagagcagtttacgctcaatcaaattattaatagctacaacgggaaagaccacgtcatagattatcatgccaaacttgacgcaaaagaaaaagaccgcgacaaagctcgaaaagagtggggaactgtcgaaaacatcaaagaactaaaagagggctatttaagccatgttatccataagatagcaactcttatcattgaacacggtgcagttgtagcgatggaagatctcaactttggctttaaacgtggacgtttcaaagttgaaaagcaagtctatcaaaaatttgaaaaagcacttatcgataagctgaactatcttgtcgataagaaaaaagagcctcataaacttggaggtcttttaaatgcgttgcaactcactagcaagtttcaaagttttgaaaaaatgggtaaacaaaacggctttttgttttatgtacctgcgtggaatacatccaaaatagatcctgttacgggttttgttaatctttttgatacccgttatgcaagtgtagaaaaatccaaagcattttttactaagtttcaatcaatttgctacaacgaagctaaagattacttcgagttagtatttgattataatgatttcacagaaaaagctaaagaaactcgaagcgagtggacactttgtacttatggtgaacgcattgtgagctttagaaacgcggagaaaaatcatcaatgggatagcaaaacaattcatcttacaacagagtttaaaaacctttttggtgagctgcatggtaatgatgtaaaagagtatattttagagcaaaattcagttgagttttttaagtcacttatctatttattaaaaattactttgcagatgcgtaactcaatcacgggtactgatatagactatcttgtctcacccgtcgcagatgaagcagggaatttttacgacagtcgtaaagccgatacatctttaccaaaagatgccgacgcaaacggtgcgtataatatcgctcgtaaaggtttaatgttgatgcatcgcatccaaaacgccgaagatctcaaaaaagtgaacttggcgatttcaaaccgtgactggctccgcaacgctcaaggactggataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 241 - DNA, 3924 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgctgagtaactttaccaaccagtatcagttatccaagaccttacgtttcgaattgaagccggtcggggatacgttgaaacacatcgagaagagtgggttgatcgcccaagacgaaatccgttcccaagagtaccaagaggttaaaacaatcatcgacaagtaccacaaagcctttatcgacgaagctttacaaaatgtggtgttatccaatcttgaggaatacgaagctcttttcttcgaacgtaatcgtgacgagaaggcgttcgagaaattgcaagctgtattgcgcaaagaaattgtagcacattttaaacaacatccccaatataagaccctttttaagaaggagttaatcaaagctgacctgaaaaattggcaagaactgagcgatgccgagaaagagttggtctcgcactttgataactttactacatacttcacgggtttccacgagaatcgcgccaatatgtacacggacgaggcgaagcacagcagtatcgcctaccgtattattcacgaaaatcttccaatctttcttactaacaagaaactgttcgaaaccattaagcagaaagctccacatttagcccaggaaacgcaggatgcattattggagtatttatccggagccatcgtggaagatatgtttgaacttagttatttcaaccacttgctgagtcagacgcatattgatctgtataatcagatgattggtggagttaagcaggatagtttaaagattcagggtctgaatgagaagattaatctttaccgtcaagcgaatgggctttcgaaacgtgaattgccgaatcttaaaccgctgcataaacaaattctgtcggatcgtgagacattatcttggcttccggaatctttcgagagtgacgaggagctgatgcaaggggtccaggcatatttcgaatctgaagttcttgcctttgaatgttgcgatgggaaggttaacttattagagaaactgccggagttgttacaccaaacacaggattatgattttagtaaagtttacttcaagaacgatttagcattgaccgctgcatcacaggcaatctttaaagactatcgtatcattaaggaggcgttgtgggaggttaataagccgaaaaaatctaaagacttagtcgctgacgaggaaaaattctttaataagaagaactcctacttctctattgagcagattgatggagcgttgaactcggcgcagctgagcgctaacatgatgcactattttcagagtgaatctacaaaggttattgaacaaatccaattgacttataacgactggaagcgtaacagtagcaacaaggaattgcttaaggcattccttgacgcactgctttcttatcagcgtcttttaaagcctttaaatgcccctaatgaccttgagaaggatgtggcattctatgcctactttgacgcctactttacaagcctgtgtggtgtcgttaaactgtacgacaaggtacgtaatttcatgaccaagaagccgtattcgttagagaaatttaagttgaattttgaaaactcgacgcttttagacggttgggatgtcaataaagaatccgacaacactgctattttatttcgtaaggaggggttgtactatctgggtattatgaataaaaagtacaataaggtctttcgtaatatttcatcatcccaagacgagggctatcaaaaaatcgactataaattacttccaggggccaataagatgctgccaaaagtgtttttcagtgataagaataaggagtatttcaagccaaacgccaagctgttggaacgttacaaagccggtgagcacaaaaaaggggataactttgatcttgacttctgtcacgaattgatcgactttttcaagacaagcatcgaaaagcaccaagactggaaacacttcgcctaccagtttagtcccaccgaatcgtacgaggacctttcaggtttttaccgtgaggtggaacaacaggggtacaaaatcagttacaaaaatatcgctgctagctttatcgatacgctggtggcagagggtaaactgtattttttccagatttacaacaaggatttcagtccatactcgaagggaactcccaacatgcacaccttatattggcgtgccttgttcgacgagaagaacttagcggatgtaatttataagttgaacggtcaggccgaaattttttttcgtaaaaagagcatcgaatattcgcaggaaaagttacaaaaggggcaccaccatgagatgttaaaggataagtttgcgtacccaattatcaaggatcgccgctttgcctttgacaagttccagtttcacgtgcctattacactgaattttaaagcggagggcaatgagaatatcactcctaagacgtttgaatatattcgctcgaatcctgataacattaaggtgattgggattgatcgcggcgagcgccacttactttacctgagtttaatcgacgcggaaggtaagattgttgaacagtttacattaaaccaaattatcaatagctacaatgggaaagaccatgtgattgactatcatgccaaattggatgcaaaggaaaaagatcgcgataaggctcgcaaggaatgggggactgtggaaaatatcaaggaattgaaagaaggttatttaagtcatgtaatccataaaatcgcaacccttattatcgagcatggcgctgttgtagcaatggaagaccttaattttggcttcaagcgcgggcgtttcaaagtggagaagcaggtgtatcagaaatttgagaaagctttaattgataaattgaattatttggttgataagaaaaaagagccgcataagttaggtggcttgttgaatgctttgcaattaacgtcaaaatttcagtctttcgaaaagatgggaaaacagaacggtttccttttctatgtgccagcctggaacacatcaaaaattgaccccgtcactgggtttgtaaacctgtttgatactcgctatgcaagcgttgaaaaaagtaaagctttcttcacgaagttccagtcaatttgctacaatgaggccaaggactactttgagttggtgttcgactacaatgactttacagagaaggctaaagaaacacgttcagagtggaccttatgtacatatggggagcgcatcgtgtcttttcgcaatgccgaaaaaaaccaccagtgggactccaaaacgattcatttgaccactgaatttaagaatttatttggggaattgcatgggaatgatgtaaaagagtatattctggaacaaaattctgttgaatttttcaaatcactgatttatcttcttaagattactcttcagatgcgcaattctatcacgggcaccgacattgactacttagtctctccggtcgcagatgaagctgggaatttctatgactcccgtaaggcggacacaagtcttccgaaagacgctgatgcgaacggtgcatacaatatcgcgcgcaaaggactgatgctgatgcaccgtatccagaacgcggaggacttgaagaaggtaaatttggccatctcaaatcgtgattggttgcgcaatgcccaaggtttagataaaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 242 - DNA, 3924 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgttgtccaattttactaatcagtaccagcttagcaaaacacttcgcttcgagttaaagcctgttggtgacacgcttaaacacattgaaaagtcgggactgatcgcacaggatgagattcgctcacaggaatatcaggaggtaaagaccattatcgacaagtatcataaagccttcattgatgaagcattgcagaatgttgtgctgtcaaacctggaagaatatgaagcgttatttttcgaacgtaaccgcgacgaaaaggcgtttgagaaacttcaagccgtactgcgtaaggagatcgtggcccactttaagcagcaccctcagtataaaacactgttcaaaaaggagttgattaaagctgatctgaagaactggcaggagttatcggatgcagagaaagagcttgtaagccattttgacaacttcaccacgtatttcaccggctttcatgaaaaccgtgcgaatatgtataccgatgaagcaaaacattcttcaattgcttaccgcatcatccatgaaaaccttccaatttttcttacaaacaagaaactttttgaaacaattaaacaaaaggcgccgcacctggcgcaagaaacccaggatgccctgttagagtatttatcaggcgctattgtagaagatatgtttgagctgagttattttaaccacttgctgagtcaaacgcatatcgacctttataatcaaatgattgggggcgtgaaacaggattcgttaaaaatccaaggacttaacgagaagatcaatttgtaccgccaggcgaacgggctgtcaaaacgcgagttgccaaatttgaaaccgttgcataaacagattttatccgaccgcgagacgttgtcgtggttacccgaatcctttgagtccgacgaagaattgatgcaaggtgttcaagcttattttgaatcggaggtcctggcctttgaatgctgcgatgggaaggtaaacctgttggagaagttgccagaacttctgcaccaaacccaggactatgatttcagcaaggtatacttcaaaaacgacctggcgttaactgctgcctctcaggccattttcaaagattaccgcattattaaggaggccctgtgggaggtgaacaaaccaaaaaagagtaaggatttggtagcagatgaggaaaaattcttcaataagaaaaatagttatttcagcatcgaacaaattgacggtgccttaaactcagcccaattgtcggctaatatgatgcattattttcagtcggagtcaacgaaagtcatcgaacagattcagctgacctataatgattggaagcgcaactcatctaataaggaattgctgaaggccttcctggatgcgttactgtcgtaccagcgccttcttaagccgttaaacgccccgaatgacttagagaaggatgtagcgttctacgcctatttcgacgcgtatttcacatctctttgtggggttgtgaagttatatgataaagtccgtaactttatgaccaagaaaccatattcactggaaaagttcaagctgaattttgagaattcgacgttgttagatggctgggatgtgaacaaggagtctgacaacacagctattttatttcgcaaagagggtctttactatcttggaatcatgaataagaagtataacaaggtctttcgcaacatcagttccagtcaggacgagggataccagaagatcgattacaaattgttaccaggagctaataagatgttgcccaaagtgtttttctcggataagaacaaagaatacttcaagcctaacgccaaactgttggaacgctataaggcgggagaacataagaaaggtgataattttgacttagatttttgtcatgagcttatcgactttttcaagacatcgattgaaaaacatcaggattggaagcattttgcctaccagttctcccccacagagtcgtacgaggacctgagtgggttctatcgcgaagttgaacaacaaggatataaaatttcctacaaaaatatcgcggcgagctttatcgatacactggtcgcggaggggaaactttatttcttccagatctataacaaagacttctcaccatattctaagggcactccgaatatgcacaccttgtattggcgcgcactgttcgatgagaagaacttggctgatgtgatctataaactgaatggtcaggcggaaattttctttcgcaaaaaatccatcgaatattcgcaggaaaagcttcagaaaggtcaccaccatgaaatgttgaaggataagttcgcctaccccattattaaggatcgtcgttttgctttcgacaaattccaattccacgtgccaatcacattgaattttaaagctgagggcaatgagaacatcacgccaaaaacgtttgagtatatccgctcaaatccagataacatcaaggtgatcgggatcgatcgtggagagcgtcaccttctgtatttgtcgttgatcgacgcggagggcaagatcgtggagcaatttacgcttaaccagattattaatagctataatggtaaggaccacgtcattgattaccatgccaagctggatgctaaggagaaggaccgcgacaaggcgcgcaaggaatggggaacagtcgagaatatcaaagagctgaaagaggggtacttatctcatgtcattcacaaaatcgccacgttaattatcgagcatggggccgtggtagcaatggaggatctgaactttggcttcaaacgtggtcgctttaaagtggagaagcaggtataccaaaaatttgaaaaagcacttatcgacaaacttaactacctggtggacaaaaagaaagaaccacataaattaggcggcctgttgaacgccctgcaactgacctctaaatttcagtccttcgagaaaatgggtaaacagaatgggtttttgttctacgttcccgcgtggaacacatcgaaaattgatccagttacagggtttgtcaacctttttgatacacgctatgcaagcgtggaaaaaagtaaagccttcttcaccaagtttcagtccatctgctacaatgaagccaaagactattttgaactggtctttgattacaacgactttacggagaaagcaaaagaaacccgttccgagtggacgctttgcacgtatggggaacgcattgtgtcgtttcgtaacgctgagaagaaccaccagtgggactctaagacgatccaccttacgacggaattcaaaaatctttttggagaattacatggtaatgacgttaaagagtatattctggagcagaattcggttgaattctttaagagcctgatctatttgttgaagatcacccttcagatgcgcaattccattacaggtacagatattgactatttggtcagtccggtagcggacgaagcggggaatttttatgattcccgcaaagcagatactagtcttcctaaggacgctgatgcaaacggagcatataacatcgcccgtaaaggacttatgttaatgcatcgtattcaaaatgcagaggatcttaagaaagtgaatcttgccatcagtaatcgcgattggttacgcaacgcacagggcctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 243 - DNA, 3924 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgctgtcgaacttcacgaatcaatatcagcttagtaaaacgttacgcttcgagttaaaaccagttggtgatactttaaaacatattgagaagagtggcctgattgcacaggacgagattcgctctcaggagtaccaggaagttaagacaatcattgataaatatcacaaggctttcattgatgaggcattacaaaacgttgtactttctaacctggaagagtatgaggctttgttttttgaacgtaaccgcgacgagaaggctttcgagaagctgcaagcagtgttacgcaaagagatcgtcgcgcattttaagcaacacccgcagtataagacattgttcaagaaagaattaatcaaagcagacctgaaaaattggcaggagctttctgacgctgagaaggagctggtcagccactttgacaatttcactacatatttcacgggattccatgagaaccgtgctaacatgtacacggatgaagccaaacatagttctattgcttaccgtatcattcacgagaatctgccaatctttttgactaacaaaaagttgttcgagacgatcaagcaaaaggcaccgcacctggcgcaagagacccaagacgccttgttagagtatttgtccggagccatcgtcgaggacatgtttgaattgtcttatttcaatcatcttcttagtcaaacccacatcgatttgtataatcaaatgattggtggcgtaaagcaggattcgttaaaaatccagggtcttaatgaaaaaatcaacctgtatcgtcaagcgaacggattatctaaacgcgaacttccgaatctgaaaccacttcataagcaaatcttgtctgaccgcgagactctgagctggttacccgagtcgttcgagagcgatgaagagttgatgcagggggtacaggcatacttcgagtcggaggtcttagcatttgagtgctgcgacggaaaggtgaatcttctggaaaaattaccggagttgcttcaccaaactcaggactacgacttttccaaagtctatttcaaaaacgacttggctttgaccgcagcgagccaagcaattttcaaggattatcgtattatcaaggaggcactttgggaagtcaacaagcccaaaaagagtaaagacctggtcgctgatgaggaaaaatttttcaataagaagaatagctacttctctattgagcaaattgacggggctcttaactccgcgcagctttcagcgaacatgatgcattattttcagtcggagtctactaaagtaatcgagcagatccagttaacctacaacgactggaagcgcaacagtagtaacaaggagttacttaaggcgtttttggatgccttattatcctaccaacgtctgttaaagcccttaaacgcacctaacgacctggaaaaggatgtagcattctacgcttacttcgatgcttatttcaccagcctttgtggagttgtgaagctgtacgataaagtacgtaattttatgactaagaaaccgtacagtttggagaagtttaagctgaattttgaaaacagcacgctgttggatggttgggacgtcaacaaggagtcagacaacaccgccatcttatttcgcaaggaaggtttatattacctgggtattatgaataagaagtacaacaaagtattccgcaacattagttctagccaagatgagggctatcaaaagatcgattacaaactgttgccgggtgcaaacaaaatgcttccaaaggtctttttctctgataaaaacaaggaatactttaaacctaatgctaaacttttagaacgctacaaagccggcgagcacaaaaagggcgacaacttcgatttagacttctgccacgagttgatcgacttcttcaagacgtctattgagaaacaccaagattggaaacatttcgcatatcaattttcgcctactgagagttacgaagatctgtccggtttctaccgcgaagtcgagcaacagggctacaaaattagctacaaaaatattgcggcgtctttcatcgacacgctggtggctgaaggaaagctgtatttttttcaaatctataacaaggacttctctccatatagcaaaggtaccccgaacatgcatacactgtactggcgcgctcttttcgacgaaaagaaccttgcagacgtaatctacaagctgaacggtcaagctgaaatttttttccgtaagaagtcaatcgaatacagccaagaaaaattacagaaaggccaccatcatgaaatgttgaaagataaatttgcatacccaattatcaaagatcgtcgcttcgctttcgataaattccagttccatgttcccattaccctgaactttaaggcggaggggaacgaaaacattacccctaaaaccttcgagtacattcgttccaacccggacaatatcaaggttatcggcatcgaccgcggtgaacgccatctgttatatcttagcttgatcgatgcggaaggtaagattgtcgagcaattcacccttaaccagatcattaactcatataatggtaaggaccacgtaatcgactatcatgcaaagcttgacgccaaggagaaggatcgcgacaaggcgcgtaaagaatggggcacagttgagaacattaaggagctgaaagaaggttacttaagtcatgtcattcacaaaattgcaacactgatcatcgaacatggtgccgtggtcgcaatggaggacctgaattttggattcaagcgcggtcgctttaaggtggaaaaacaagtctatcaaaaatttgaaaaagctttaattgataaacttaactaccttgttgacaagaaaaaggagcctcacaaattaggtgggcttctgaatgcgctgcaattaacgtccaagtttcaatccttcgaaaaaatgggaaaacagaatggttttttattctatgtcccggcttggaacacaagtaaaattgatcctgttaccggcttcgtgaatttgttcgatacccgctacgcgagcgtagaaaaatctaaagcatttttcaccaaatttcagagtatctgctataatgaggcaaaggattattttgaattggttttcgactataatgattttacagaaaaagctaaagagactcgttctgagtggaccttgtgtacgtatggtgaacgtatcgtaagcttccgcaacgctgaaaaaaatcaccagtgggactctaaaacgattcatttgacaaccgagtttaaaaaccttttcggagaattgcacggtaacgacgttaaggaatatatcttagaacaaaattcggtcgaatttttcaagtcccttatctatcttttgaaaatcactcttcagatgcgcaattcgatcacagggaccgatatcgattatcttgtttcacctgtggctgacgaagcaggcaacttttacgacagccgcaaggccgacactagcttaccgaaagacgcagatgctaacggcgcctacaatatcgctcgcaaaggtcttatgcttatgcatcgcattcaaaacgctgaggacttaaagaaggttaatttagcgatttctaatcgtgactggttgcgtaacgcgcaagggctggacaagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 244 - DNA, 3924 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgttgtctaacttcaccaaccagtatcaattatcgaaaactctgcgttttgagcttaaacccgtcggggatacgcttaaacatattgagaaaagcgggctgatcgcccaagacgaaatccgtagccaagagtatcaggaagtcaaaaccattatcgataagtaccacaaggcattcatcgacgaggcgttgcagaacgttgtactttctaatttggaagaatacgaggctctgttttttgagcgtaaccgcgacgaaaaggcgttcgagaagctgcaagcagtgttgcgtaaagaaattgtagcgcactttaaacaacacccccaatacaagactttgtttaaaaaagagcttattaaggccgatttaaaaaactggcaagagctgtccgacgctgagaaggaattggtgagtcatttcgacaactttacaacatatttcacgggattccacgaaaatcgcgcaaatatgtacacggatgaagctaagcatagcagcatcgcatatcgtatcattcacgaaaacttaccgatctttcttacgaacaaaaaacttttcgagacgattaagcaaaaggccccccaccttgcccaggagacacaggatgcgcttcttgagtatttgtcaggtgcaattgtcgaagacatgttcgaactgtcatattttaaccacttgttatcccaaactcatatcgacctttataatcagatgattggtggcgttaaacaagacagcttgaagatccaaggactgaatgaaaaaatcaatctttaccgccaggctaacggcttatcaaagcgcgaattgccaaacttgaaacccctgcacaaacagattctgagtgaccgtgagacactgtcttggttaccagagagcttcgagtcagacgaagagttaatgcagggtgtgcaggcctacttcgaatcagaggtcttagcctttgagtgttgtgatggtaaagtgaatctgctggaaaaattgccggaactgcttcaccagacccaagattacgactttagcaaagtctattttaaaaacgaccttgctttgacggcagcctcccaggcgatttttaaagattatcgtatcattaaggaggcgttatgggaggtgaataagcctaaaaaatccaaggatctggttgcagatgaggagaaattttttaataagaagaatagttatttcagtatcgagcagattgacggagcactgaatagtgctcaattgtccgccaatatgatgcactattttcaatcagagtcaaccaaggttattgaacagatccagttgacttataacgactggaagcgtaactcatcgaacaaagaacttttaaaagcattcttagacgcgcttttgtcttaccaacgtctgcttaaacctctgaatgcgcctaacgatttagaaaaagatgttgcattttatgcttacttcgatgcgtacttcacgtctttgtgtggagttgtaaaactttacgataaagtacgcaattttatgaccaagaaaccatatagcttggaaaaatttaagttaaactttgagaactccactcttttggacggatgggatgtaaacaaggaatcggataataccgcgattctttttcgtaaggaaggactttattatctgggcatcatgaataagaagtacaataaggtattccgtaatatctcttcttcacaagatgaaggttaccagaagattgattacaaattactgccaggtgccaataaaatgttgccgaaagtttttttttcggataaaaacaaggagtatttcaaaccgaacgcgaagttattagagcgctacaaagctggcgagcataaaaaaggggacaactttgatttagacttctgccatgagttaatcgacttcttcaagacatcaattgaaaaacaccaagactggaagcattttgcctatcagttctcgccaaccgagagttatgaggatctgtcagggttctatcgcgaggttgaacagcaagggtataagatctcttacaaaaatatcgcagcctcttttatcgatactcttgtcgcggaaggaaagctgtatttcttccagatttataataaggatttttcaccgtactctaagggtacacctaatatgcacacattgtactggcgcgctctgttcgatgagaaaaaccttgccgacgtaatctacaaattgaatgggcaagcagagatcttcttccgcaaaaagtcgattgaatattcgcaagaaaaattacaaaaaggtcatcatcacgagatgctgaaggataagtttgcatacccgatcattaaagatcgtcgctttgctttcgataaattccagttccacgtgccaatcacattgaatttcaaggctgagggaaatgagaatattacacctaaaacctttgagtatatccgttctaatcctgataacatcaaagtgatcggaattgaccgtggggaacgccatcttctgtacttatcattgattgatgcggagggcaagattgtggagcaatttaccttgaaccagattattaactcatacaacggaaaggatcatgtaatcgattaccatgcgaaattagatgcgaaggagaaggatcgcgacaaagcccgcaaagagtggggtacagttgaaaacattaaagagttgaaggagggttatctgagccatgtcatccataagatcgctactttgattattgagcatggagcggttgtggcaatggaagatttgaacttcggcttcaagcgtgggcgtttcaaggttgagaaacaagtttatcagaaatttgaaaaggcgcttattgataagttaaattacttggtagacaagaagaaggaaccccacaagctgggggggttattaaatgctttgcaacttacaagtaaattccagagcttcgagaaaatgggaaaacagaacgggtttttgttctatgtgcctgcctggaacacgtcaaagatcgaccctgtgaccgggttcgtaaaccttttcgacactcgttatgcaagcgttgagaagagtaaggccttttttacgaaatttcagtcgatctgttacaacgaagcgaaggactactttgaactggtctttgactataatgactttactgaaaaggccaaggaaacccgctcagaatggacgttatgtacatacggcgagcgtattgtgagctttcgtaacgcggagaagaaccatcaatgggacagcaagaccattcatcttacaacggaatttaagaatctgtttggagagttacacggcaacgatgtgaaggagtatatccttgagcagaactcggtggaattctttaagtcccttatctatttgcttaaaatcactctgcagatgcgtaattctattacaggaactgatattgattacttagtgtcgccggtagctgatgaagccgggaatttctatgacagccgtaaagcggacaccagcttgcccaaggatgcggacgccaatggcgcgtataatattgcacgcaaaggactgatgttaatgcaccgcattcagaacgcagaggacctgaagaaggtaaatcttgcgatctccaatcgcgactggttacgtaacgcccagggccttgataagaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 245 - DNA, 3855 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtatcttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgattaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 246 - DNA, 3855 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttgtttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 247 - DNA, 3855 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtactatcagggactgactaagctttatcccatctcgaaaacgattcgcaatgaattgatcccagtcgggaaaacgttagagcatatccgtatgaataatattcttgaagcagacatccagcgcaagtccgattacgagcgtgtgaaaaaattaatggatgattatcataaacaattaatcaatgagtcgttgcaggatgtgcatttgtcatacgtggaggaagcggctgacctttacttaaatgcttctaaagataaggatatcgttgacaagttcagcaagtgccaagataaattgcgcaaggaaatcgtgaacctgctgaagagccatgagaattttccgaagatcgggaataaagagattattaagcttttgcaaagcctttccgatacggaaaaagattacaatgcgttggactcgttctcgaagttttatacctactttacctcatataatgaagtacgcaaaaatctttattcagatgaagaaaagtctagtacggctgcctatcgtctgatcaatgaaaatcttccaaagtttctggacaatattaaagcttactcaatcgccaagtcggcgggagtgcgcgcgaaggaattgacagaggaggaacaagactgtttgttcatgacggaaacctttgaacgcactcttacgcaagacgggattgacaactacaatgaattgatcggaaagctgaactttgccattaatttgtataatcagcaaaacaacaagcttaaaggtttccgtaaagtccctaagatgaaggagttgtacaaacaaatccttagcgagcgtgaagcatcctttgtggatgaatttgtagatgacgaggccttgttgaccaatgtggaatcgttctcagcacacattaaggagtttttagaatccgactcactgtcccgttttgctgaagttttggaagagagtgggggggaaatggtttatattaagaatgatacctctaagacgactttttcgaatatcgtctttgggtcatggaatgtgatcgacgagcgtttggccgaggagtacgatagtgccaattccaaaaaaaaaaaagacgaaaagtattatgataaacgtcacaaagaacttaagaagaacaaatcctattccgtagagaagattgtgtcactgtctacagaaactgaggatgtaattggaaagtacattgagaagcttcaagccgatatcatcgctatcaaagagacccgtgaagtgtttgaaaaagtcgtcctgaaagaacacgataagaacaaatcactgcgtaagaacacgaaagctatcgaagctattaagtcgttccttgacactatcaaggacttcgaacgtgatatcaaattaatctcgggttcagaacacgaaatggaaaaaaatttagcggtttacgctgaacaggaaaatattttaagcagtattcgtaacgtcgactcattatacaacatgtcgcgcaattaccttactcaaaaaccattttccacggaaaaatttaagttgaatttcaatcgtgccacccttttaaatggttgggacaagaataaggaaacggataaccttggaattttactggttaaggagggaaagtattatttgggcatcatgaacactaaggctaacaaaagcttcgttaacccgcccaagccgaagacagataatgtataccacaaagttaattataaactgttgccaggtccgaataagatgcttcccaaggtgttcttcgccaaaagcaacctggagtactacaagccgtctgaggatcttcttgctaaatatcaggctggcacgcataagaagggcgaaaattttagcttagaagactgccacagcctgatttcattcttcaaggacagtttggaaaagcatcctgattggtcagagtttggatttaaattttcggatacaaaaaaatacgacgacctttcgggtttctaccgtgaggtagaaaaacaaggatataagatcacatataccgatatcgacgtagagtacatcgactccttagtagagaaagacgagctgtatttattccagatttacaataaggacttttcaccatactctaaagggaattataatctgcacaccttgtaccttacaatgttattcgacgaacgtaatctgcgcaacgtggtatacaagctgaatggggaagcggaagtattttatcgccccgcttcaatcggtaaagacgaattaattatccataagtcaggggaggagatcaagaataagaatcctaaacgtgctattgataagcccacatccacgttcgagtatgatattgtaaaggaccgccgctatacaaaggataagtttatgttacatatcccggttaccatgaacttcggtgtggacgagactcgccgtttcaatgaggtcgttaatgacgcaattcgtggtgacgataaagtccgtgtcattggaatcgatcgcggagaacgtaatttattgtacgtggtcgtagtggactccgatggaacaattttggaacagatctctcttaattcgatcatcaataatgaatacagtatcgagacggactaccacaaattacttgatgaaaaggagggtgatcgcgaccgtgctcgcaagaactggacaacgattgagaatatcaaagaactgaaggagggttatctttcgcaggtcgttaatgtgatcgcaaaattggtattaaaatacgatgcaatcatctgcttagaagatttgaatttcggtttcaaacgcggacgccaaaaagtcgagaagcaggtctaccagaagtttgaaaagatgttaatcgacaaattgaattaccttgtaatcgataaatctcgttcacaagaaaatccagaagaagttggacacgttctgaacgcgttacaactgacaagcaaatttacaagctttaaagagcttgggaaacaaactggtatcatctattatgttccagcctatttgacatccaagatcgatccaactactggtttcgcgaacttgttttacgtcaaatatgagtcagtggaaaagtcaaaggattttttcaatcgctttgatagtatttgctttaacaaagtggccggctatttcgaatttagctttgattacaagaacttcactgaccgtgcttgcggtatgcgttcgaagtggaaagtgtgtactaacggcgagcgcatcatcaaatatcgtaacgaagagaagaactcctccttcgacgacaaggtcatcgtccttaccgaagaatttaaaaaattgtttaatgaatatggtattgctttcaatgattgtatggacttgacggatgcaattaacgctatcgacgacgcgagcttcttccgtaaattgaccaaattatttcagcagacgctgcaaatgcgcaacagcagtgctgatgggtcgcgtgattacatcattagtccggtcgagaacgataatggggagtttttcaactctgaaaaatgcgacaagtcaaagcctaaggacgcagatgccaatggagcgtttaacattgcccgtaagggtttgtgggtgctggagcaattatacaacagtagctctggggagaagctgaacctggcaatgactaatgccgagtggttagagtacgcgcaacaacacactatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 248 - DNA, 3855 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattaccagggcttaactaagttatatccgatctcaaagaccattcgcaatgagttgattcccgtaggcaagacacttgaacacatccgcatgaataacattcttgaagcagacatccaacgcaaatcggattacgagcgcgtaaaaaagttgatggatgattatcacaaacaattaatcaacgaatctcttcaggacgtacacttaagctacgtggaagaggctgcagatctgtaccttaatgccagtaaggacaaagatattgtagataaattctcgaaatgtcaggacaaacttcgtaaggagatcgtaaatttgcttaagtcacacgaaaacttcccaaaaatcggtaataaagaaatcatcaagctgcttcaatctcttagcgacacagaaaaagattacaatgctttggactcgttttctaagttctacacatatttcacgagttacaatgaagtacgcaaaaatttatacagcgacgaagagaagagcagcaccgcggcatatcgcttgatcaatgagaatctgcccaaatttttagataacatcaaggcttattcgattgctaagtcggcaggggttcgcgcgaaggagcttacagaagaggaacaggattgtctgtttatgacagaaaccttcgagcgtactctgacacaggatgggattgacaactacaacgaattaatcggaaaacttaattttgcgattaacctgtacaatcaacaaaataacaagctgaagggcttccgtaaagtgcccaagatgaaagaactttataaacaaatcttgagtgagcgcgaggcatctttcgtggacgaatttgttgacgatgaggccttgctgaccaatgtggagagcttttctgcccacatcaaggagttcctggaatcagatagtcttagtcgctttgcggaagttcttgaggaaagcgggggtgagatggtatacattaaaaatgatacatctaaaactactttcagcaatatcgtgtttgggtcgtggaacgtcatcgacgagcgcctggcagaagaatacgacagcgctaattcgaaaaaaaaaaaagatgagaaatactatgacaaacgccacaaagagctgaaaaaaaataaaagctatagtgtcgaaaaaattgtctctctgtctaccgaaactgaagatgttattggtaaatatattgaaaaactgcaagctgatatcatcgcaatcaaagaaacccgtgaggtattcgagaaagtcgtactgaaggaacatgacaagaacaagtctcttcgtaagaacaccaaagccattgaagccattaagtcattccttgacactatcaaggattttgaacgtgacattaaactgatcagtgggagcgaacacgagatggagaaaaacttggccgtctatgccgaacaagaaaatattttaagttcaattcgtaacgttgattccctttacaatatgtcacgtaactatttgacacaaaagccgttttcaacagaaaagttcaagttgaactttaaccgcgcaacattacttaatggatgggacaagaacaaagagacggataatcttggcatcctgctggtcaaagaaggcaaatattatttgggtattatgaatactaaggcaaataaatcattcgttaacccccctaagcctaaaaccgacaacgtgtatcataaggtgaattacaagttattacctggccccaacaaaatgctgccgaaagttttcttcgcaaagtctaatttggagtactacaaaccttctgaagatcttctggctaaatatcaggcgggaacccacaaaaaaggtgaaaattttagcttggaagattgccacagtttaatttccttttttaaggattccttagaaaaacacccagattggtccgaattcggcttcaaattttcagatactaagaagtatgacgatctgtcgggcttctaccgcgaggtggaaaaacaagggtacaagattacttatacagatatcgacgtcgagtatattgactctttggttgaaaaggacgaactgtatctttttcagatctacaacaaagactttagtccttacagtaagggcaactacaaccttcatactttatacctgacaatgcttttcgacgaacgcaatcttcgtaacgtggtttataaattgaatggcgaggcagaagtgttttaccgcccggcgtctattggaaaggacgagcttatcatccataagtccggggaagagatcaagaataagaaccctaagcgcgctattgacaaaccgacatccacgtttgaatacgatattgttaaggaccgccgctacactaaagacaaattcatgttgcatattccggtcaccatgaattttggggttgatgaaacacgtcgtttcaatgaagtagtaaacgatgctatccgcggagacgataaggtacgcgtcattggaattgatcgcggagaacgcaatctgttatacgtagttgtcgtagactcagatgggaccattctggagcagattagcttgaacagtattatcaacaacgagtattcaattgagaccgattaccataaactgttagatgaaaaagagggtgatcgtgatcgtgcgcgcaagaattggacgactatcgaaaatatcaaggaattaaaagagggatacctgtctcaggtagtaaatgtgattgctaagttggtgctgaaatacgacgctatcatctgcttggaggatcttaacttcggtttcaagcgtgggcgccaaaaggtcgagaaacaggtctaccaaaagtttgaaaaaatgttaattgacaaattgaactacttagtgattgataaatcacgctcacaggaaaacccagaggaagttggacacgttttaaacgccttacaactgacgagtaagtttacctcttttaaagaattaggtaaacagacgggcatcatttattatgtccctgcctacttaaccagtaagatcgatccgacgacaggatttgctaatcttttctatgtcaaatacgaaagcgtagaaaaaagtaaagatttctttaaccgcttcgactccatttgcttcaataaagtagccggctacttcgaattttcgttcgactacaagaactttaccgaccgcgcgtgcggtatgcgtagcaaatggaaggtttgcacaaatggtgagcgtatcatcaagtatcgcaacgaagaaaaaaacagcagctttgacgataaggtgatcgtgttgacggaggaatttaagaagctgttcaacgaatatggtattgctttcaatgattgtatggacttgacggatgccattaacgcaattgacgatgcaagcttttttcgtaagttgactaaattgtttcaacaaactctgcaaatgcgtaattcttcggcagacggttctcgcgattacattatttcgccggtagagaatgataacggcgaattcttcaattcggaaaagtgcgacaagagcaaacctaaggatgcggatgcgaacggggccttcaacatcgcccgtaaagggttgtgggtgctggagcaattatacaatagttcatcaggagagaaacttaatctggcgatgactaatgctgagtggctggagtacgcccaacaacatacaatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 249 - DNA, 3954 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtatcttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgattaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 250 - DNA, 3954 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttgtttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 251 - DNA, 3954 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtactatcagggactgactaagctttatcccatctcgaaaacgattcgcaatgaattgatcccagtcgggaaaacgttagagcatatccgtatgaataatattcttgaagcagacatccagcgcaagtccgattacgagcgtgtgaaaaaattaatggatgattatcataaacaattaatcaatgagtcgttgcaggatgtgcatttgtcatacgtggaggaagcggctgacctttacttaaatgcttctaaagataaggatatcgttgacaagttcagcaagtgccaagataaattgcgcaaggaaatcgtgaacctgctgaagagccatgagaattttccgaagatcgggaataaagagattattaagcttttgcaaagcctttccgatacggaaaaagattacaatgcgttggactcgttctcgaagttttatacctactttacctcatataatgaagtacgcaaaaatctttattcagatgaagaaaagtctagtacggctgcctatcgtctgatcaatgaaaatcttccaaagtttctggacaatattaaagcttactcaatcgccaagtcggcgggagtgcgcgcgaaggaattgacagaggaggaacaagactgtttgttcatgacggaaacctttgaacgcactcttacgcaagacgggattgacaactacaatgaattgatcggaaagctgaactttgccattaatttgtataatcagcaaaacaacaagcttaaaggtttccgtaaagtccctaagatgaaggagttgtacaaacaaatccttagcgagcgtgaagcatcctttgtggatgaatttgtagatgacgaggccttgttgaccaatgtggaatcgttctcagcacacattaaggagtttttagaatccgactcactgtcccgttttgctgaagttttggaagagagtgggggggaaatggtttatattaagaatgatacctctaagacgactttttcgaatatcgtctttgggtcatggaatgtgatcgacgagcgtttggccgaggagtacgatagtgccaattccaaaaaaaaaaaagacgaaaagtattatgataaacgtcacaaagaacttaagaagaacaaatcctattccgtagagaagattgtgtcactgtctacagaaactgaggatgtaattggaaagtacattgagaagcttcaagccgatatcatcgctatcaaagagacccgtgaagtgtttgaaaaagtcgtcctgaaagaacacgataagaacaaatcactgcgtaagaacacgaaagctatcgaagctattaagtcgttccttgacactatcaaggacttcgaacgtgatatcaaattaatctcgggttcagaacacgaaatggaaaaaaatttagcggtttacgctgaacaggaaaatattttaagcagtattcgtaacgtcgactcattatacaacatgtcgcgcaattaccttactcaaaaaccattttccacggaaaaatttaagttgaatttcaatcgtgccacccttttaaatggttgggacaagaataaggaaacggataaccttggaattttactggttaaggagggaaagtattatttgggcatcatgaacactaaggctaacaaaagcttcgttaacccgcccaagccgaagacagataatgtataccacaaagttaattataaactgttgccaggtccgaataagatgcttcccaaggtgttcttcgccaaaagcaacctggagtactacaagccgtctgaggatcttcttgctaaatatcaggctggcacgcataagaagggcgaaaattttagcttagaagactgccacagcctgatttcattcttcaaggacagtttggaaaagcatcctgattggtcagagtttggatttaaattttcggatacaaaaaaatacgacgacctttcgggtttctaccgtgaggtagaaaaacaaggatataagatcacatataccgatatcgacgtagagtacatcgactccttagtagagaaagacgagctgtatttattccagatttacaataaggacttttcaccatactctaaagggaattataatctgcacaccttgtaccttacaatgttattcgacgaacgtaatctgcgcaacgtggtatacaagctgaatggggaagcggaagtattttatcgccccgcttcaatcggtaaagacgaattaattatccataagtcaggggaggagatcaagaataagaatcctaaacgtgctattgataagcccacatccacgttcgagtatgatattgtaaaggaccgccgctatacaaaggataagtttatgttacatatcccggttaccatgaacttcggtgtggacgagactcgccgtttcaatgaggtcgttaatgacgcaattcgtggtgacgataaagtccgtgtcattggaatcgatcgcggagaacgtaatttattgtacgtggtcgtagtggactccgatggaacaattttggaacagatctctcttaattcgatcatcaataatgaatacagtatcgagacggactaccacaaattacttgatgaaaaggagggtgatcgcgaccgtgctcgcaagaactggacaacgattgagaatatcaaagaactgaaggagggttatctttcgcaggtcgttaatgtgatcgcaaaattggtattaaaatacgatgcaatcatctgcttagaagatttgaatttcggtttcaaacgcggacgccaaaaagtcgagaagcaggtctaccagaagtttgaaaagatgttaatcgacaaattgaattaccttgtaatcgataaatctcgttcacaagaaaatccagaagaagttggacacgttctgaacgcgttacaactgacaagcaaatttacaagctttaaagagcttgggaaacaaactggtatcatctattatgttccagcctatttgacatccaagatcgatccaactactggtttcgcgaacttgttttacgtcaaatatgagtcagtggaaaagtcaaaggattttttcaatcgctttgatagtatttgctttaacaaagtggccggctatttcgaatttagctttgattacaagaacttcactgaccgtgcttgcggtatgcgttcgaagtggaaagtgtgtactaacggcgagcgcatcatcaaatatcgtaacgaagagaagaactcctccttcgacgacaaggtcatcgtccttaccgaagaatttaaaaaattgtttaatgaatatggtattgctttcaatgattgtatggacttgacggatgcaattaacgctatcgacgacgcgagcttcttccgtaaattgaccaaattatttcagcagacgctgcaaatgcgcaacagcagtgctgatgggtcgcgtgattacatcattagtccggtcgagaacgataatggggagtttttcaactctgaaaaatgcgacaagtcaaagcctaaggacgcagatgccaatggagcgtttaacattgcccgtaagggtttgtgggtgctggagcaattatacaacagtagctctggggagaagctgaacctggcaatgactaatgccgagtggttagagtacgcgcaacaacacactatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 252 - DNA, 3954 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgtattaccagggcttaactaagttatatccgatctcaaagaccattcgcaatgagttgattcccgtaggcaagacacttgaacacatccgcatgaataacattcttgaagcagacatccaacgcaaatcggattacgagcgcgtaaaaaagttgatggatgattatcacaaacaattaatcaacgaatctcttcaggacgtacacttaagctacgtggaagaggctgcagatctgtaccttaatgccagtaaggacaaagatattgtagataaattctcgaaatgtcaggacaaacttcgtaaggagatcgtaaatttgcttaagtcacacgaaaacttcccaaaaatcggtaataaagaaatcatcaagctgcttcaatctcttagcgacacagaaaaagattacaatgctttggactcgttttctaagttctacacatatttcacgagttacaatgaagtacgcaaaaatttatacagcgacgaagagaagagcagcaccgcggcatatcgcttgatcaatgagaatctgcccaaatttttagataacatcaaggcttattcgattgctaagtcggcaggggttcgcgcgaaggagcttacagaagaggaacaggattgtctgtttatgacagaaaccttcgagcgtactctgacacaggatgggattgacaactacaacgaattaatcggaaaacttaattttgcgattaacctgtacaatcaacaaaataacaagctgaagggcttccgtaaagtgcccaagatgaaagaactttataaacaaatcttgagtgagcgcgaggcatctttcgtggacgaatttgttgacgatgaggccttgctgaccaatgtggagagcttttctgcccacatcaaggagttcctggaatcagatagtcttagtcgctttgcggaagttcttgaggaaagcgggggtgagatggtatacattaaaaatgatacatctaaaactactttcagcaatatcgtgtttgggtcgtggaacgtcatcgacgagcgcctggcagaagaatacgacagcgctaattcgaaaaaaaaaaaagatgagaaatactatgacaaacgccacaaagagctgaaaaaaaataaaagctatagtgtcgaaaaaattgtctctctgtctaccgaaactgaagatgttattggtaaatatattgaaaaactgcaagctgatatcatcgcaatcaaagaaacccgtgaggtattcgagaaagtcgtactgaaggaacatgacaagaacaagtctcttcgtaagaacaccaaagccattgaagccattaagtcattccttgacactatcaaggattttgaacgtgacattaaactgatcagtgggagcgaacacgagatggagaaaaacttggccgtctatgccgaacaagaaaatattttaagttcaattcgtaacgttgattccctttacaatatgtcacgtaactatttgacacaaaagccgttttcaacagaaaagttcaagttgaactttaaccgcgcaacattacttaatggatgggacaagaacaaagagacggataatcttggcatcctgctggtcaaagaaggcaaatattatttgggtattatgaatactaaggcaaataaatcattcgttaacccccctaagcctaaaaccgacaacgtgtatcataaggtgaattacaagttattacctggccccaacaaaatgctgccgaaagttttcttcgcaaagtctaatttggagtactacaaaccttctgaagatcttctggctaaatatcaggcgggaacccacaaaaaaggtgaaaattttagcttggaagattgccacagtttaatttccttttttaaggattccttagaaaaacacccagattggtccgaattcggcttcaaattttcagatactaagaagtatgacgatctgtcgggcttctaccgcgaggtggaaaaacaagggtacaagattacttatacagatatcgacgtcgagtatattgactctttggttgaaaaggacgaactgtatctttttcagatctacaacaaagactttagtccttacagtaagggcaactacaaccttcatactttatacctgacaatgcttttcgacgaacgcaatcttcgtaacgtggtttataaattgaatggcgaggcagaagtgttttaccgcccggcgtctattggaaaggacgagcttatcatccataagtccggggaagagatcaagaataagaaccctaagcgcgctattgacaaaccgacatccacgtttgaatacgatattgttaaggaccgccgctacactaaagacaaattcatgttgcatattccggtcaccatgaattttggggttgatgaaacacgtcgtttcaatgaagtagtaaacgatgctatccgcggagacgataaggtacgcgtcattggaattgatcgcggagaacgcaatctgttatacgtagttgtcgtagactcagatgggaccattctggagcagattagcttgaacagtattatcaacaacgagtattcaattgagaccgattaccataaactgttagatgaaaaagagggtgatcgtgatcgtgcgcgcaagaattggacgactatcgaaaatatcaaggaattaaaagagggatacctgtctcaggtagtaaatgtgattgctaagttggtgctgaaatacgacgctatcatctgcttggaggatcttaacttcggtttcaagcgtgggcgccaaaaggtcgagaaacaggtctaccaaaagtttgaaaaaatgttaattgacaaattgaactacttagtgattgataaatcacgctcacaggaaaacccagaggaagttggacacgttttaaacgccttacaactgacgagtaagtttacctcttttaaagaattaggtaaacagacgggcatcatttattatgtccctgcctacttaaccagtaagatcgatccgacgacaggatttgctaatcttttctatgtcaaatacgaaagcgtagaaaaaagtaaagatttctttaaccgcttcgactccatttgcttcaataaagtagccggctacttcgaattttcgttcgactacaagaactttaccgaccgcgcgtgcggtatgcgtagcaaatggaaggtttgcacaaatggtgagcgtatcatcaagtatcgcaacgaagaaaaaaacagcagctttgacgataaggtgatcgtgttgacggaggaatttaagaagctgttcaacgaatatggtattgctttcaatgattgtatggacttgacggatgccattaacgcaattgacgatgcaagcttttttcgtaagttgactaaattgtttcaacaaactctgcaaatgcgtaattcttcggcagacggttctcgcgattacattatttcgccggtagagaatgataacggcgaattcttcaattcggaaaagtgcgacaagagcaaacctaaggatgcggatgcgaacggggccttcaacatcgcccgtaaagggttgtgggtgctggagcaattatacaatagttcatcaggagagaaacttaatctggcgatgactaatgctgagtggctggagtacgcccaacaacatacaatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttgaaaacctgtatttccagggagggagtggatctggcggctcaggcgactacaaagaccatgacggtgattataaagatcatgacatcgattacaaggatgacgatgacaag

SEQ ID NO: 253 - DNA, 3948 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgtattatcagggtttaacaaagctatatccaattagtaaaactattagaaacgaattaattcctgtaggaaagactttagaacatattagaatgaataatattcttgaggctgatattcagagaaaatcagattatgaacgtgtaaagaagctaatggatgactatcataagcaattaataaatgagtctttgcaagatgtccatttgtcttatgttgaggaggcagctgatctatatctaaatgcttctaaggataaagatattgtagataagtttagtaagtgtcaggataaattgcgaaaagagatagttaatctcttgaagagtcatgaaaactttccaaagataggaaacaaggaaataataaaattactacagagtctttctgatactgaaaaagactataacgcgttggattcatttagcaagttttatacatattttactagctacaatgaggttagaaagaatttgtattccgatgaagaaaaatcatccacagcggcatatcgattgataaatgaaaatttgcctaaatttctagataatattaaggcttattctattgctaaatctgcaggtgtgcgagctaaagaactgaccgaagaagaacaggattgtctttttatgactgaaacttttgaaaggacacttactcaggatggaattgataattataacgaattgattggaaagcttaattttgcgattaatctatataatcagcaaaataataaactcaagggatttcgtaaagtacctaagatgaaagaactgtataaacagattttgtcggaaagagaggcatcatttgttgatgaatttgttgatgatgaagcattgctaactaacgtagagtctttttctgcacatattaaagagtttttggaatcggattctctttcaagatttgcggaagtccttgaagaatctggtggggaaatggtttatataaaaaatgatacttcaaagacaacattttcaaatatagtatttggctcttggaacgtaattgatgaaagattggcagaggaatatgattctgctaattctaagaaaaagaaggacgaaaaatattacgataagcgtcataaagaactgaaaaagaacaagagctattctgtggagaagatagtttcattatcaacggaaacagaggatgtgattggaaaatatatagagaagcttcaagcggacattattgctataaaagagacgcgagaagtttttgagaaagttgttcttaaggagcatgataagaataaatctcttagaaagaatactaaagccatcgaggcaattaaatcatttttagatacaataaaagattttgagcgagatataaaacttattagcggtagcgagcatgagatggagaagaatcttgccgtttatgcagagcaagagaatattttatcttcaattagaaatgtggattctctatacaatatgtcaagaaattatctcacccaaaagcctttttcaacagaaaagtttaagttgaattttaatagggcaacattattaaatgggtgggataaaaataaagaaactgataatctaggtattcttttggtaaaagaaggaaaatattacttaggaattatgaatactaaagctaataaaagttttgtaaatccacctaagccgaagacagacaatgtatatcataaagtgaattataagctattaccaggaccaaataagatgttgcctaaggtcttttttgcaaagtcaaatcttgaatattacaaaccatcagaagacttgctagcaaaatatcaagcgggtacacataagaaaggagagaatttttctttagaagattgccattcattgatttctttctttaaagactctctagaaaagcatccagactggtcagaatttggatttaagttttctgatacaaaaaaatatgatgatttgagtggattttatagagaggtagagaagcaaggatataagataacatatacggatattgatgtagagtatattgatagtttggttgaaaaagatgagttgtatcttttccaaatctacaataaggatttctcgccatatagtaaggggaattataatctccacacgctatatctgacgatgttatttgatgagcgtaatttacgtaatgtggtttataaattaaatggtgaggctgaagttttttatagacctgcttcaattggaaaggatgaactaattattcataaatctggagaggaaataaagaataagaatccaaagagggctattgataaaccaacaagtacattcgaatatgatatcgtcaaagatcgaagatatactaaggataaatttatgttacatattccagtaactatgaattttggcgtggatgaaactagaagattcaatgaggtcgttaatgatgctataaggggagatgataaagttagagtcattggaattgatagaggcgagagaaatttattatatgtagtagttgttgattctgatggaactattttggagcagatttctcttaattctattattaataatgagtattcgatagaaacagattatcacaaattgctggatgagaaagaaggggatagagacagagcacgcaaaaattggactactatagaaaatattaaagaacttaaagaggggtatctaagtcaggtagttaatgttatagcaaaattggttttgaaatatgatgctattatctgccttgaagatttgaattttggatttaagcgtggacgtcaaaaagttgaaaaacaggtatatcagaaattcgaaaaaatgcttattgataaattgaattatttagttattgataagagtagaagccaagagaatcctgaagaagttggacatgtcttgaatgcgttacagttaacttcaaaatttactagttttaaggaattaggtaaacagacaggtattatttattacgttcctgcgtatttaactagtaaaattgatccgacaacaggtttcgcaaatctcttttacgtaaaatatgagagtgttgaaaagtccaaagatttctttaatagatttgatagcatttgttttaacaaagtagcaggttattttgagtttagctttgattataaaaactttactgatagagcctgtggtatgagaagtaaatggaaagtatgtaccaatggtgaacgaatcattaaatatagaaatgaagaaaagaacagttcttttgatgataaggtgatagttttaacggaagaatttaagaagttgttcaatgagtatggcattgcttttaatgattgtatggacctgactgatgcaataaatgctattgatgatgctagtttcttcagaaagttgactaaattgttccaacagacattgcagatgcgaaatagttcggctgatggttccagagattatattatctcgccagttgagaatgataacggggagttttttaactccgaaaaatgcgataaatcaaaaccaaaagatgctgatgctaatggagcatttaatattgccagaaagggattatgggtgttagaacaactttataattcatcatcaggagaaaagcttaatttagcaatgacaaatgctgaatggttagagtatgcacagcaacatacgattaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 254 - DNA, 3948 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgtattaccaggggttgaccaaattgtacccgatcagcaagacaatccgtaacgagcttatccctgttggaaaaacgttggagcacattcgcatgaataatattttagaggccgacatccagcgcaaatcggattatgagcgtgtcaagaagttgatggatgactatcacaaacagttgatcaacgagtcgttgcaagatgttcacttgagttacgtcgaagaagccgccgatctgtacttaaatgcttccaaagacaaagatattgtggataagttttcgaagtgtcaagacaagcttcgcaaggagattgtgaaccttttaaagagccacgagaactttccgaagatcggaaataaggagatcattaagttacttcagtcattgagtgacactgaaaaagactacaacgctcttgactctttctcaaagttttacacgtattttacttcatataatgaggtgcgtaaaaacttgtattccgacgaggaaaaaagctcaacagccgcctaccgtcttattaacgagaacttacctaagttcctggataatattaaggcttacagcattgccaagagcgcaggggtgcgtgcgaaagaactgacggaggaggagcaagattgtttgtttatgacagagacattcgagcgcacattaactcaggacgggattgataattacaacgaactgattggcaagcttaattttgcgatcaacttatataaccaacaaaataacaaactgaagggcttccgtaaggtaccgaaaatgaaggaactttataaacaaattctgagtgaacgtgaagcaagttttgtagacgaatttgtagatgacgaggctttactgaccaacgttgaaagcttcagcgcacacattaaagaatttttagagagtgattcgttatctcgctttgccgaggtattagaagagtcggggggagaaatggtatacattaagaacgacacctcgaagacaaccttcagtaacatcgttttcggatcatggaatgtcatcgacgaacgcttggccgaggaatacgacagcgcaaactccaaaaagaagaaagatgaaaagtattatgataaacgccacaaagagctgaaaaagaataaatcctattcagtggaaaagatcgtcagcttaagtacagagactgaggacgtgattggtaaatatattgaaaaacttcaggctgatatcatcgcaatcaaggaaacacgtgaagtctttgaaaaggtagttctgaaggaacacgataaaaacaagagcctgcgtaagaataccaaagccattgaggcaatcaaatcttttttagatactatcaaagattttgagcgtgatatcaaactgatttcagggtctgagcacgaaatggagaaaaaccttgctgtgtacgcagagcaagaaaacatcctgtcgtcgattcgtaatgtagattctttgtacaatatgtcccgtaactacttaacgcagaagccttttagtaccgaaaaatttaaacttaacttcaatcgcgccaccttattaaatggttgggacaaaaataaagaaactgataacttaggcatcttgctggtgaaggaaggaaaatattatcttgggatcatgaatacaaaggcaaacaagtcattcgtgaatcccccgaagccgaaaacagacaatgtataccacaaagtaaactacaaacttcttccaggcccaaataaaatgttaccgaaggtcttcttcgctaagtcaaacctggaatattataaaccttcggaagatttattggcaaaatatcaggccgggacgcacaaaaaaggggagaatttctcccttgaagactgtcactctcttatctcgtttttcaaagactcgttggagaagcaccctgactggagtgaattcgggtttaagtttagcgatactaagaagtatgatgacctgagcggtttctaccgcgaggtggagaagcaaggatataaaattacctataccgacattgatgttgagtacatcgatagtcttgtcgaaaaggatgagctttacttgtttcaaatctacaataaagacttttcaccttatagtaaaggtaactacaatctgcacacactgtacctgacgatgctgttcgatgagcgtaatttgcgtaacgtcgtctataaattgaatggtgaggcggaggttttctaccgcccagcgtctatcggcaaggacgaattgattatccacaagagtggagaggaaattaagaacaagaatcctaaacgtgctattgacaagccaacctccacgtttgagtacgatattgttaaagaccgccgctacactaaggataagtttatgctgcacattccagtgacaatgaactttggcgttgatgagacccgccgttttaacgaggtcgtcaacgatgcaattcgtggggacgacaaggtacgtgtcattggtattgaccgtggcgagcgcaatctgctgtacgtcgtcgtggttgactctgacgggacgatccttgagcaaattagtctgaattccattattaataacgaatacagcattgaaaccgactaccataagcttttggacgaaaaggaaggcgaccgtgaccgcgctcgtaaaaattggactacaattgagaatatcaaagaattaaaagaaggctaccttagccaagttgtaaacgtgatcgcaaaattggtattgaaatacgatgccatcatctgtttggaagatttaaactttgggtttaaacgtggccgccaaaaagtggagaagcaggtatatcaaaagtttgaaaagatgttaattgataaacttaattatttggtaattgacaaatcccgtagccaagaaaatccggaagaggtgggtcatgtcctgaacgcccttcaattaactagtaagttcactagctttaaggagttgggcaaacaaactggcattatctattacgtcccggcctatcttaccagcaagattgaccctaccactggcttcgccaatttattttacgtcaagtatgaaagtgtagagaagtctaaagacttttttaatcgttttgattcgatctgtttcaacaaggtagccggatactttgagtttagtttcgactacaaaaatttcacagaccgcgcctgcggcatgcgtagcaagtggaaagtctgtacgaatggagaacgcatcattaaatatcgcaacgaggaaaagaattcgtcattcgatgataaggtcatcgtgctgaccgaagaatttaagaagctttttaacgaatatggtatcgcgttcaatgactgtatggatttaacagacgctatcaatgcgattgatgatgctagctttttccgcaagctgacaaagttatttcaacaaacattgcaaatgcgcaactcctccgctgacggctctcgcgattatattatttctcccgtagaaaacgataatggagagttctttaatagcgagaagtgtgacaaatcgaaaccaaaggacgccgatgctaacggtgcgttcaatattgcacgcaagggactttgggtcttagagcagttgtataacagctccagcggtgaaaaacttaatctggccatgaccaatgctgaatggttggagtacgcgcagcagcacaccatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 255 - DNA, 3948 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgtactatcagggactgactaagctttatcccatctcgaaaacgattcgcaatgaattgatcccagtcgggaaaacgttagagcatatccgtatgaataatattcttgaagcagacatccagcgcaagtccgattacgagcgtgtgaaaaaattaatggatgattatcataaacaattaatcaatgagtcgttgcaggatgtgcatttgtcatacgtggaggaagcggctgacctttacttaaatgcttctaaagataaggatatcgttgacaagttcagcaagtgccaagataaattgcgcaaggaaatcgtgaacctgctgaagagccatgagaattttccgaagatcgggaataaagagattattaagcttttgcaaagcctttccgatacggaaaaagattacaatgcgttggactcgttctcgaagttttatacctactttacctcatataatgaagtacgcaaaaatctttattcagatgaagaaaagtctagtacggctgcctatcgtctgatcaatgaaaatcttccaaagtttctggacaatattaaagcttactcaatcgccaagtcggcgggagtgcgcgcgaaggaattgacagaggaggaacaagactgtttgttcatgacggaaacctttgaacgcactcttacgcaagacgggattgacaactacaatgaattgatcggaaagctgaactttgccattaatttgtataatcagcaaaacaacaagcttaaaggtttccgtaaagtccctaagatgaaggagttgtacaaacaaatccttagcgagcgtgaagcatcctttgtggatgaatttgtagatgacgaggccttgttgaccaatgtggaatcgttctcagcacacattaaggagtttttagaatccgactcactgtcccgttttgctgaagttttggaagagagtgggggggaaatggtttatattaagaatgatacctctaagacgactttttcgaatatcgtctttgggtcatggaatgtgatcgacgagcgtttggccgaggagtacgatagtgccaattccaaaaaaaaaaaagacgaaaagtattatgataaacgtcacaaagaacttaagaagaacaaatcctattccgtagagaagattgtgtcactgtctacagaaactgaggatgtaattggaaagtacattgagaagcttcaagccgatatcatcgctatcaaagagacccgtgaagtgtttgaaaaagtcgtcctgaaagaacacgataagaacaaatcactgcgtaagaacacgaaagctatcgaagctattaagtcgttccttgacactatcaaggacttcgaacgtgatatcaaattaatctcgggttcagaacacgaaatggaaaaaaatttagcggtttacgctgaacaggaaaatattttaagcagtattcgtaacgtcgactcattatacaacatgtcgcgcaattaccttactcaaaaaccattttccacggaaaaatttaagttgaatttcaatcgtgccacccttttaaatggttgggacaagaataaggaaacggataaccttggaattttactggttaaggagggaaagtattatttgggcatcatgaacactaaggctaacaaaagcttcgttaacccgcccaagccgaagacagataatgtataccacaaagttaattataaactgttgccaggtccgaataagatgcttcccaaggtgttcttcgccaaaagcaacctggagtactacaagccgtctgaggatcttcttgctaaatatcaggctggcacgcataagaagggcgaaaattttagcttagaagactgccacagcctgatttcattcttcaaggacagtttggaaaagcatcctgattggtcagagtttggatttaaattttcggatacaaaaaaatacgacgacctttcgggtttctaccgtgaggtagaaaaacaaggatataagatcacatataccgatatcgacgtagagtacatcgactccttagtagagaaagacgagctgtatttattccagatttacaataaggacttttcaccatactctaaagggaattataatctgcacaccttgtaccttacaatgttattcgacgaacgtaatctgcgcaacgtggtatacaagctgaatggggaagcggaagtattttatcgccccgcttcaatcggtaaagacgaattaattatccataagtcaggggaggagatcaagaataagaatcctaaacgtgctattgataagcccacatccacgttcgagtatgatattgtaaaggaccgccgctatacaaaggataagtttatgttacatatcccggttaccatgaacttcggtgtggacgagactcgccgtttcaatgaggtcgttaatgacgcaattcgtggtgacgataaagtccgtgtcattggaatcgatcgcggagaacgtaatttattgtacgtggtcgtagtggactccgatggaacaattttggaacagatctctcttaattcgatcatcaataatgaatacagtatcgagacggactaccacaaattacttgatgaaaaggagggtgatcgcgaccgtgctcgcaagaactggacaacgattgagaatatcaaagaactgaaggagggttatctttcgcaggtcgttaatgtgatcgcaaaattggtattaaaatacgatgcaatcatctgcttagaagatttgaatttcggtttcaaacgcggacgccaaaaagtcgagaagcaggtctaccagaagtttgaaaagatgttaatcgacaaattgaattaccttgtaatcgataaatctcgttcacaagaaaatccagaagaagttggacacgttctgaacgcgttacaactgacaagcaaatttacaagctttaaagagcttgggaaacaaactggtatcatctattatgttccagcctatttgacatccaagatcgatccaactactggtttcgcgaacttgttttacgtcaaatatgagtcagtggaaaagtcaaaggattttttcaatcgctttgatagtatttgctttaacaaagtggccggctatttcgaatttagctttgattacaagaacttcactgaccgtgcttgcggtatgcgttcgaagtggaaagtgtgtactaacggcgagcgcatcatcaaatatcgtaacgaagagaagaactcctccttcgacgacaaggtcatcgtccttaccgaagaatttaaaaaattgtttaatgaatatggtattgctttcaatgattgtatggacttgacggatgcaattaacgctatcgacgacgcgagcttcttccgtaaattgaccaaattatttcagcagacgctgcaaatgcgcaacagcagtgctgatgggtcgcgtgattacatcattagtccggtcgagaacgataatggggagtttttcaactctgaaaaatgcgacaagtcaaagcctaaggacgcagatgccaatggagcgtttaacattgcccgtaagggtttgtgggtgctggagcaattatacaacagtagctctggggagaagctgaacctggcaatgactaatgccgagtggttagagtacgcgcaacaacacactatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 256 - DNA, 3948 bp, Artificial Sequence
  Description of Artificial Sequence: Synthetic polynucleotide
atgggccatcaccaccatcaccaccatcacgggtcaggagactataaggaccacgacggagactacaaggatcatgatattgattacaaagacgatgacgataaggggagtggatctggcggctcaggcgagaatttgtatttccagagcccagcggctaaaaaaaagaaactggatggaagcggctcgggtggcagcggtatgtattaccagggcttaactaagttatatccgatctcaaagaccattcgcaatgagttgattcccgtaggcaagacacttgaacacatccgcatgaataacattcttgaagcagacatccaacgcaaatcggattacgagcgcgtaaaaaagttgatggatgattatcacaaacaattaatcaacgaatctcttcaggacgtacacttaagctacgtggaagaggctgcagatctgtaccttaatgccagtaaggacaaagatattgtagataaattctcgaaatgtcaggacaaacttcgtaaggagatcgtaaatttgcttaagtcacacgaaaacttcccaaaaatcggtaataaagaaatcatcaagctgcttcaatctcttagcgacacagaaaaagattacaatgctttggactcgttttctaagttctacacatatttcacgagttacaatgaagtacgcaaaaatttatacagcgacgaagagaagagcagcaccgcggcatatcgcttgatcaatgagaatctgcccaaatttttagataacatcaaggcttattcgattgctaagtcggcaggggttcgcgcgaaggagcttacagaagaggaacaggattgtctgtttatgacagaaaccttcgagcgtactctgacacaggatgggattgacaactacaacgaattaatcggaaaacttaattttgcgattaacctgtacaatcaacaaaataacaagctgaagggcttccgtaaagtgcccaagatgaaagaactttataaacaaatcttgagtgagcgcgaggcatctttcgtggacgaatttgttgacgatgaggccttgctgaccaatgtggagagcttttctgcccacatcaaggagttcctggaatcagatagtcttagtcgctttgcggaagttcttgaggaaagcgggggtgagatggtatacattaaaaatgatacatctaaaactactttcagcaatatcgtgtttgggtcgtggaacgtcatcgacgagcgcctggcagaagaatacgacagcgctaattcgaaaaaaaaaaaagatgagaaatactatgacaaacgccacaaagagctgaaaaaaaataaaagctatagtgtcgaaaaaattgtctctctgtctaccgaaactgaagatgttattggtaaatatattgaaaaactgcaagctgatatcatcgcaatcaaagaaacccgtgaggtattcgagaaagtcgtactgaaggaacatgacaagaacaagtctcttcgtaagaacaccaaagccattgaagccattaagtcattccttgacactatcaaggattttgaacgtgacattaaactgatcagtgggagcgaacacgagatggagaaaaacttggccgtctatgccgaacaagaaaatattttaagttcaattcgtaacgttgattccctttacaatatgtcacgtaactatttgacacaaaagccgttttcaacagaaaagttcaagttgaactttaaccgcgcaacattacttaatggatgggacaagaacaaagagacggataatcttggcatcctgctggtcaaagaaggcaaatattatttgggtattatgaatactaaggcaaataaatcattcgttaacccccctaagcctaaaaccgacaacgtgtatcataaggtgaattacaagttattacctggccccaacaaaatgctgccgaaagttttcttcgcaaagtctaatttggagtactacaaaccttctgaagatcttctggctaaatatcaggcgggaacccacaaaaaaggtgaaaattttagcttggaagattgccacagtttaatttccttttttaaggattccttagaaaaacacccagattggtccgaattcggcttcaaattttcagatactaagaagtatgacgatctgtcgggcttctaccgcgaggtggaaaaacaagggtacaagattacttatacagatatcgacgtcgagtatattgactctttggttgaaaaggacgaactgtatctttttcagatctacaacaaagactttagtccttacagtaagggcaactacaaccttcatactttatacctgacaatgcttttcgacgaacgcaatcttcgtaacgtggtttataaattgaatggcgaggcagaagtgttttaccgcccggcgtctattggaaaggacgagcttatcatccataagtccggggaagagatcaagaataagaaccctaagcgcgctattgacaaaccgacatccacgtttgaatacgatattgttaaggaccgccgctacactaaagacaaattcatgttgcatattccggtcaccatgaattttggggttgatgaaacacgtcgtttcaatgaagtagtaaacgatgctatccgcggagacgataaggtacgcgtcattggaattgatcgcggagaacgcaatctgttatacgtagttgtcgtagactcagatgggaccattctggagcagattagcttgaacagtattatcaacaacgagtattcaattgagaccgattaccataaactgttagatgaaaaagagggtgatcgtgatcgtgcgcgcaagaattggacgactatcgaaaatatcaaggaattaaaagagggatacctgtctcaggtagtaaatgtgattgctaagttggtgctgaaatacgacgctatcatctgcttggaggatcttaacttcggtttcaagcgtgggcgccaaaaggtcgagaaacaggtctaccaaaagtttgaaaaaatgttaattgacaaattgaactacttagtgattgataaatcacgctcacaggaaaacccagaggaagttggacacgttttaaacgccttacaactgacgagtaagtttacctcttttaaagaattaggtaaacagacgggcatcatttattatgtccctgcctacttaaccagtaagatcgatccgacgacaggatttgctaatcttttctatgtcaaatacgaaagcgtagaaaaaagtaaagatttctttaaccgcttcgactccatttgcttcaataaagtagccggctacttcgaattttcgttcgactacaagaactttaccgaccgcgcgtgcggtatgcgtagcaaatggaaggtttgcacaaatggtgagcgtatcatcaagtatcgcaacgaagaaaaaaacagcagctttgacgataaggtgatcgtgttgacggaggaatttaagaagctgttcaacgaatatggtattgctttcaatgattgtatggacttgacggatgccattaacgcaattgacgatgcaagcttttttcgtaagttgactaaattgtttcaacaaactctgcaaatgcgtaattcttcggcagacggttctcgcgattacattatttcgccggtagagaatgataacggcgaattcttcaattcggaaaagtgcgacaagagcaaacctaaggatgcggatgcgaacggggccttcaacatcgcccgtaaagggttgtgggtgctggagcaattatacaatagttcatcaggagagaaacttaatctggcgatgactaatgctgagtggctggagtacgcccaacaacatacaatcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 257 - protein, 1276 aa, Artificial Sequence
  Description of Artificial Sequence: Synthetic polypeptide
MGHHHHHHSSGVDLGTENLYFQSPAAKKKKLDGSVDMLSNFTNQYQLSKTLRFELKPVGDTLKHIEKSGLIAQDEIRSQEYQEVKTIIDKYHKAFIDEALQNVVLSNLEEYEALFFERNRDEKAFEKLQAVLRKEIVAHFKQHPQYKTLFKKELIKADLKNWQELSDAEKELVSHFDNFTTYFTGFHENRANMYTDEAKHSSIAYRIIHENLPIFLTNKKLFETIKQKAPHLAQETQDALLEYLSGAIVEDMFELSYFNHLLSQTHIDLYNQMIGGVKQDSLKIQGLNEKINLYRQANGLSKRELPNLKPLHKQILSDRETLSWLPESFESDEELMQGVQAYFESEVLAFECCDGKVNLLEKLPELLHQTQDYDFSKVYFKNDLALTAASQAIFKDYRIIKEALWEVNKPKKSKDLVADEEKFFNKKNSYFSIEQIDGALNSAQLSANMMHYFQSESTKVIEQIQLTYNDWKRNSSNKELLKAFLDALLSYQRLLKPLNAPNDLEKDVAFYAYFDAYFTSLCGVVKLYDKVRNFMTKKPYSLEKFKLNFENSTLLDGWDVNKESDNTAILFRKEGLYYLGIMNKKYNKVFRNISSSQDEGYQKIDYKLLPGANKMLPKVFFSDKNKEYFKPNAKLLERYKAGEHKKGDNFDLDFCHELIDFFKTSIEKHQDWKHFAYQFSPTESYEDLSGFYREVEQQGYKISYKNIAASFIDTLVAEGKLYFFQIYNKDFSPYSKGTPNMHTLYWRALFDEKNLADVIYKLNGQAEIFFRKKSIEYSQEKLQKGHHHEMLKDKFAYPIIKDRRFAFDKFQFHVPITLNFKAEGNENITPKTFEYIRSNPDNIKVIGIDRGERHLLYLSLIDAEGKIVEQFTLNQIINSYNGKDHVIDYHAKLDAKEKDRDKARKEWGTVENIKELKEGYLSHVIHKIATLIIEHGAVVAMEDLNFGFKRGRFKVEKQVYQKFEKALIDKLNYLVDKKKEPHKLGGLLNALQLTSKFQSFEKMGKQNGFLFYVPAWNTSKIDPVTGFVNLFDTRYASVEKSKAFFTKFQSICYNEAKDYFELVFDYNDFTEKAKETRSEWTLCTYGERIVSFRNAEKNHQWDSKTIHLTTEFKNLFGELHGNDVKEYILEQNSVEFFKSLIYLLKITLQMRNSITGTDIDYLVSPVADEAGNFYDSRKADTSLPKDADANGAYNIARKGLMLMHRIQNAEDLKKVNLAISNRDWLRNAQGLDKKRPAATKKAGQAKKKKASGSGAGSPKKKRKVEDPKKKRKVIPG

SEQ ID NO: 258 - protein, 1310 aa, Artificial Sequence
  Description of Artificial Sequence: Synthetic polypeptide
MGHHHHHHSSGVDLGTENLYFQSPAAKKKKLDGSVDMLSNFTNQYQLSKTLRFELKPVGDTLKHIEKSGLIAQDEIRSQEYQEVKTIIDKYHKAFIDEALQNVVLSNLEEYEALFFERNRDEKAFEKLQAVLRKEIVAHFKQHPQYKTLFKKELIKADLKNWQELSDAEKELVSHFDNFTTYFTGFHENRANMYTDEAKHSSIAYRIIHENLPIFLTNKKLFETIKQKAPHLAQETQDALLEYLSGAIVEDMFELSYFNHLLSQTHIDLYNQMIGGVKQDSLKIQGLNEKINLYRQANGLSKRELPNLKPLHKQILSDRETLSWLPESFESDEELMQGVQAYFESEVLAFECCDGKVNLLEKLPELLHQTQDYDFSKVYFKNDLALTAASQAIFKDYRIIKEALWEVNKPKKSKDLVADEEKFFNKKNSYFSIEQIDGALNSAQLSANMMHYFQSESTKVIEQIQLTYNDWKRNSSNKELLKAFLDALLSYQRLLKPLNAPNDLEKDVAFYAYFDAYFTSLCGVVKLYDKVRNFMTKKPYSLEKFKLNFENSTLLDGWDVNKESDNTAILFRKEGLYYLGIMNKKYNKVFRNISSSQDEGYQKIDYKLLPGANKMLPKVFFSDKNKEYFKPNAKLLERYKAGEHKKGDNFDLDFCHELIDFFKTSIEKHQDWKHFAYQFSPTESYEDLSGFYREVEQQGYKISYKNIAASFIDTLVAEGKLYFFQIYNKDFSPYSKGTPNMHTLYWRALFDEKNLADVIYKLNGQAEIFFRKKSIEYSQEKLQKGHHHEMLKDKFAYPIIKDRRFAFDKFQFHVPITLNFKAEGNENITPKTFEYIRSNPDNIKVIGIDRGERHLLYLSLIDAEGKIVEQFTLNQIINSYNGKDHVIDYHAKLDAKEKDRDKARKEWGTVENIKELKEGYLSHVIHKIATLIIEHGAVVAMEDLNFGFKRGRFKVEKQVYQKFEKALIDKLNYLVDKKKEPHKLGGLLNALQLTSKFQSFEKMGKQNGFLFYVPAWNTSKIDPVTGFVNLFDTRYASVEKSKAFFTKFQSICYNEAKDYFELVFDYNDFTEKAKETRSEWTLCTYGERIVSFRNAEKNHQWDSKTIHLTTEFKNLFGELHGNDVKEYILEQNSVEFFKSLIYLLKITLQMRNSITGTDIDYLVSPVADEAGNFYDSRKADTSLPKDADANGAYNIARKGLMLMHRIQNAEDLKKVNLAISNRDWLRNAQGLDKKRPAATKKAGQAKKKKASGSGAGSPKKKRKVEDPKKKRKVENLYFQGGSGSGGSGDYKDHDGDYKDHDIDYKDDDDK

SEQ ID NO: 259 - protein, 1307 aa, Artificial Sequence
  Description of Artificial Sequence: Synthetic polypeptide
MGHHHHHHHHGSGDYKDHDGDYKDHDIDYKDDDDKGSGSGGSGENLYFQSPAAKKKKLDGSGSGGSGMLSNFTNQYQLSKTLRFELKPVGDTLKHIEKSGLIAQDEIRSQEYQEVKTIIDKYHKAFIDEALQNVVLSNLEEYEALFFERNRDEKAFEKLQAVLRKEIVAHFKQHPQYKTLFKKELIKADLKNWQELSDAEKELVSHFDNFTTYFTGFHENRANMYTDEAKHSSIAYRIIHENLPIFLTNKKLFETIKQKAPHLAQETQDALLEYLSGAIVEDMFELSYFNHLLSQTHIDLYNQMIGGVKQDSLKIQGLNEKINLYRQANGLSKRELPNLKPLHKQILSDRETLSWLPESFESDEELMQGVQAYFESEVLAFECCDGKVNLLEKLPELLHQTQDYDFSKVYFKNDLALTAASQAIFKDYRIIKEALWEVNKPKKSKDLVADEEKFFNKKNSYFSIEQIDGALNSAQLSANMMHYFQSESTKVIEQIQLTYNDWKRNSSNKELLKAFLDALLSYQRLLKPLNAPNDLEKDVAFYAYFDAYFTSLCGVVKLYDKVRNFMTKKPYSLEKFKLNFENSTLLDGWDVNKESDNTAILFRKEGLYYLGIMNKKYNKVFRNISSSQDEGYQKIDYKLLPGANKMLPKVFFSDKNKEYFKPNAKLLERYKAGEHKKGDNFDLDFCHELIDFFKTSIEKHQDWKHFAYQFSPTESYEDLSGFYREVEQQGYKISYKNIAASFIDTLVAEGKLYFFQIYNKDFSPYSKGTPNMHTLYWRALFDEKNLADVIYKLNGQAEIFFRKKSIEYSQEKLQKGHHHEMLKDKFAYPIIKDRRFAFDKFQFHVPITLNFKAEGNENITPKTFEYIRSNPDNIKVIGIDRGERHLLYLSLIDAEGKIVEQFTLNQIINSYNGKDHVIDYHAKLDAKEKDRDKARKEWGTVENIKELKEGYLSHVIHKIATLIIEHGAVVAMEDLNFGFKRGRFKVEKQVYQKFEKALIDKLNYLVDKKKEPHKLGGLLNALQLTSKFQSFEKMGKQNGFLFYVPAWNTSKIDPVTGFVNLFDTRYASVEKSKAFFTKFQSICYNEAKDYFELVFDYNDFTEKAKETRSEWTLCTYGERIVSFRNAEKNHQWDSKTIHLTTEFKNLFGELHGNDVKEYILEQNSVEFFKSLIYLLKITLQMRNSITGTDIDYLVSPVADEAGNFYDSRKADTSLPKDADANGAYNIARKGLMLMHRIQNAEDLKKVNLAISNRDWLRNAQGLDKKRPAATKKAGQAKKKKASGSGAGSPKKKRKVEDPKKKRKVIPG

SEQ ID NO: 260 - protein, 1284 aa, Artificial Sequence
  Description of Artificial Sequence: Synthetic polypeptide
MGHHHHHHSSGVDLGTENLYFQSPAAKKKKLDGSVDMYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTIKRPAATKKAGQAKKKKASGSGAGSPKKKRKVEDPKKKRKVIPG

SEQ ID NO: 261 - protein, 1318 aa, Artificial Sequence
  Description of Artificial Sequence: Synthetic polypeptide
MGHHHHHHSSGVDLGTENLYFQSPAAKKKKLDGSVDMYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTIKRPAATKKAGQAKKKKASGSGAGSPKKKRKVEDPKKKRKVENLYFQGGSGSGGSGDYKDHDGDYKDHDIDYKDDDDK

SEQ ID NO: 262 - protein, 1315 aa, Artificial Sequence
  Description of Artificial Sequence: Synthetic polypeptide
MGHHHHHHHHGSGDYKDHDGDYKDHDIDYKDDDDKGSGSGGSGENLYFQSPAAKKKKLDGSGSGGSGMYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTIKRPAATKKAGQAKKKKASGSGAGSPKKKRKVEDPKKKRKVIPG

SEQ ID NO: 263 - protein, 7 aa, Simian virus 40
PKKKRKV

SEQ ID NO: 264 - protein, 16 aa, Unknown
  Description of Unknown: Nucleoplasmin bipartite NLS sequence
KRPAATKKAGQAKKKK

SEQ ID NO: 265 - protein, 9 aa, Unknown
  Description of Unknown: C-myc NLS sequence
PAAKRVKLD

SEQ ID NO: 266 - protein, 11 aa, Unknown
  Description of Unknown: C-myc NLS sequence
RQRRNELKRSP

SEQ ID NO: 267 - protein, 38 aa, Homo sapiens
NQSSNFGPMKGGNFGGRSSGPYGGGGQYFAKPRNQGGY

SEQ ID NO: 268 - protein, 41 aa, Unknown
  Description of Unknown: IBB domain from importin-alpha sequence
RMRIFKNKGKDTAELRRRRVEVSVELRKAKKDEQILKRRNV

SEQ ID NO: 269 - protein, 8 aa, Unknown
  Description of Unknown: Myoma T protein sequence
VSRKRPRP

SEQ ID NO: 270 - protein, 8 aa, Unknown
  Description of Unknown: Myoma T protein sequence
PPKKARED

SEQ ID NO: 271 - protein, 8 aa, Homo sapiens
PQPKKKPL

SEQ ID NO: 272 - protein, 12 aa, Mus musculus
SALIKKKKKMAP

SEQ ID NO: 273 - protein, 5 aa, Influenza virus
DRLRR

SEQ ID NO: 274 - protein, 7 aa, Influenza virus
PKQKKRK

SEQ ID NO: 275 - protein, 10 aa, Hepatitis delta virus
RKLKKKIKKL

SEQ ID NO: 276 - protein, 10 aa, Mus musculus
REKKKFLKRR

SEQ ID NO: 277 - protein, 20 aa, Homo sapiens
KRKGDEVDGVDEVAKKKSKK

SEQ ID NO: 278 - protein, 17 aa, Homo sapiens
RKCLQAGMNLEARKTKK

SEQ ID NO: 279 - protein, 9 aa, Unknown
  Description of Unknown: Nuclear localization sequence
PAAKKKKLD

SEQ ID NO: 280 - protein, 22 aa, Artificial Sequence
  Description of Artificial Sequence: Synthetic peptide
DYKDHDGDYKDHDIDYKDDDDK

SEQ ID NO: 281 - protein, 8 aa, Artificial Sequence
  Description of Artificial Sequence: Synthetic peptide
DYKDDDDK

SEQ ID NO: 282 - protein, 10 aa, Unknown
  Description of Unknown: ART nuclease motif sequence
FLFQIYNKDF

SEQ ID NO: 283 - protein, 10 aa, Unknown
  Description of Unknown: ART nuclease motif sequence
YFFQIYNKDF

SEQ ID NO: 284 - protein, 10 aa, Unknown
  Description of Unknown: ART nuclease motif sequence
YLFQLYNKDY

SEQ ID NO: 285 - protein, 10 aa, Unknown
  Description of Unknown: ART nuclease motif sequence
YLFEIYNKDF

SEQ ID NO: 286 - protein, 10 aa, Unknown
  Description of Unknown: ART nuclease motif sequence
YLFQLYNKDF

SEQ ID NO: 287 - protein, 10 aa, Unknown
  Description of Unknown: ART nuclease motif sequence
FLFKMSNKDL

SEQ ID NO: 288 - protein, 10 aa, Unknown
  Description of Unknown: ART nuclease motif sequence
FLFKMSNKDL

SEQ ID NO: 289 - protein, 10 aa, Unknown
  Description of Unknown: ART nuclease motif sequence
FLFQIYNKDF

SEQ ID NO: 290 - protein, 10 aa, Unknown
  Description of Unknown: ART nuclease motif sequence
YLFKIYNKDF

SEQ ID NO: 291 - RNA, 36 nt, Artificial Sequence
  Description of Artificial Sequence: Synthetic oligonucleotide
gucuauaugacaaaguaauuucuacuauguguagau

SEQ ID NO: 292 - RNA, 36 nt, Artificial Sequence
  Description of Artificial Sequence: Synthetic oligonucleotide
gucuaaagguaccaccaaauuucuacuguuguagau

SEQ ID NO: 293 - RNA, 36 nt, Artificial Sequence
  Description of Artificial Sequence: Synthetic oligonucleotide
gguauaaaccauaguaaaauuucugcuauugcagau

SEQ ID NO: 294 - RNA, 36 nt, Artificial Sequence
  Description of Artificial Sequence: Synthetic oligonucleotide
guugaauaaccuuaaauaauuucuacuguuguagau

SEQ ID NO: 295 - RNA, 33 nt, Artificial Sequence
  Description of Artificial Sequence: Synthetic oligonucleotide
cucuaagaggcauauaaaauuucuacuguugua

SEQ ID NO: 296 - RNA, 36 nt, Artificial Sequence
  Description of Artificial Sequence: Synthetic oligonucleotide
guuuaauaacccuauauaauuucuacuauuguagau

SEQ ID NO: 297 - RNA, 36 nt, Artificial Sequence
  Description of Artificial Sequence: Synthetic oligonucleotide
ggcuauaaugccuaaguaauuucuacuauuguagau

SEQ ID NO: 298 - RNA, 36 nt, Artificial Sequence
  Description of Artificial Sequence: Synthetic oligonucleotide
guuuaauacaccuauaagauuucuacuuuuguagau

SEQ ID NO: 299 - RNA, 36 nt, Artificial Sequence; identical to SEQ ID NO: 297
  Description of Artificial Sequence: Synthetic oligonucleotide

SEQ ID NO: 300 - RNA, 36 nt, Artificial Sequence
  Description of Artificial Sequence: Synthetic oligonucleotide
ggcuaacagccuuuuaaauuucuacuguguguagau

SEQ ID NO: 301 - RNA, 36 nt, Artificial Sequence
  Description of Artificial Sequence: Synthetic oligonucleotide
gcuuagaaccuuuaaauaauuucuacuauuguagau

SEQ ID NO: 302 - RNA, 36 nt, Artificial Sequence
  Description of Artificial Sequence: Synthetic oligonucleotide
ggcuaguaugcuucaauaauuucuacuauuguagau

SEQ ID NO: 303 - RNA, 36 nt, Artificial Sequence; identical to SEQ ID NO: 302
  Description of Artificial Sequence: Synthetic oligonucleotide

SEQ ID NO: 304 - RNA, 36 nt, Artificial Sequence; identical to SEQ ID NO: 302
  Description of Artificial Sequence: Synthetic oligonucleotide

SEQ ID NO: 305 - RNA, 36 nt, Artificial Sequence
  Description of Artificial Sequence: Synthetic oligonucleotide
gucuaacgaccuuuuaaauuucuacuguuuguagau

SEQ ID NO: 306 - RNA, 36 nt, Artificial Sequence; identical to SEQ ID NO: 305
  Description of Artificial Sequence: Synthetic oligonucleotide

SEQ ID NO: 307 - RNA, 36 nt, Artificial Sequence; identical to SEQ ID NO: 305
  Description of Artificial Sequence: Synthetic oligonucleotide

SEQ ID NO: 308 - RNA, 37 nt, Artificial Sequence
  Description of Artificial Sequence: Synthetic oligonucleotide
ggcuacauaaagccuauaauuucuacuauguguagau

SEQ ID NO: 309 - RNA, 36 nt, Artificial Sequence
  Description of Artificial Sequence: Synthetic oligonucleotide
gucuauaugacuaaguaauuucuacuauguguagau

SEQ ID NO: 310 - RNA, 36 nt, Artificial Sequence; identical to SEQ ID NO: 309
  Description of Artificial Sequence: Synthetic oligonucleotide

SEQ ID NO: 311 - RNA, 36 nt, Artificial Sequence; identical to SEQ ID NO: 309
  Description of Artificial Sequence: Synthetic oligonucleotide

SEQ ID NO: 312 - RNA, 36 nt, Artificial Sequence; identical to SEQ ID NO: 305
  Description of Artificial Sequence: Synthetic oligonucleotide

SEQ ID NO: 313 - RNA, 36 nt, Artificial Sequence; identical to SEQ ID NO: 294
  Description of Artificial Sequence: Synthetic oligonucleotide

SEQ ID NO: 314 - RNA, 36 nt, Artificial Sequence
  Description of Artificial Sequence: Synthetic oligonucleotide
gucuaacgaccuuuaaaauuucuacuauuuguagau

SEQ ID NO: 315 - RNA, 36 nt, Artificial Sequence
  Description of Artificial Sequence: Synthetic oligonucleotide
guuaaguaaccuauaguaauuucuacuguuguagau

SEQ ID NO: 316 - RNA, 36 nt, Artificial Sequence; identical to SEQ ID NO: 315
  Description of Artificial Sequence: Synthetic oligonucleotide

SEQ ID NO: 317 - RNA, 36 nt, Artificial Sequence; identical to SEQ ID NO: 296
  Description of Artificial Sequence: Synthetic oligonucleotide

SEQ ID NO: 318 - RNA, 36 nt, Artificial Sequence
  Description of Artificial Sequence: Synthetic oligonucleotide
cucuaagagaagguauaaauuucuacuguuguagau

SEQ ID NO: 319 - RNA, 36 nt, Artificial Sequence; identical to SEQ ID NO: 296
  Description of Artificial Sequence: Synthetic oligonucleotide

SEQ ID NO: 320 - RNA, 36 nt, Artificial Sequence; identical to SEQ ID NO: 296
  Description of Artificial Sequence: Synthetic oligonucleotide

SEQ ID NO: 321 - RNA, 36 nt, Artificial Sequence; identical to SEQ ID NO: 296
  Description of Artificial Sequence: Synthetic oligonucleotide

SEQ ID NO: 322 - RNA, 37 nt, Artificial Sequence
  Description of Artificial Sequence: Synthetic oligonucleotide
guuuaauaacccuauauaauuucuacuauuguagaua

SEQ ID NO: 323 - RNA, 36 nt, Artificial Sequence
  Description of Artificial Sequence: Synthetic oligonucleotide
guuuaaucaacccuuagaauuucuacuauuguagau

SEQ ID NO: 324 - RNA, 36 nt, Artificial Sequence
  Description of Artificial Sequence: Synthetic oligonucleotide
cucuaagagaggauauaaauuucuacuguuguagau

SEQ ID NO: 325 - RNA, 36 nt, Artificial Sequence; identical to SEQ ID NO: 297
  Description of Artificial Sequence: Synthetic oligonucleotide

SEQ ID NO: 326 - DNA, 57 bp, Artificial Sequence
  Description of Artificial Sequence: Synthetic primer
tcgtcggcagcgtcagatgtgtataagagacagcgtaccctggttggcagcgaatac

SEQ ID NO: 327 - DNA, 56 bp, Artificial Sequence
  Description of Artificial Sequence: Synthetic primer
gtctcgtgggctcggagatgtgtataagagacagacgcacgcgttttgccacgatc

SEQ ID NO: 328 - DNA, 30 bp, Artificial Sequence
  Description of Artificial Sequence: Synthetic primer
agctttacttctttcaaatctacaataaag

SEQ ID NO: 329 - DNA, 18 bp, Artificial Sequence
  Description of Artificial Sequence: Synthetic primer
catccttttcgacaagac

SEQ ID NO: 330 - DNA, 3591 bp, Artificial Sequence
  Description of Artificial Sequence: Synthetic polynucleotide
atgttgtctaacttcaccaaccagtatcaattatcgaaaactctgcgttttgagcttaaacccgtcggggatacgcttaaacatattgagaaaagcgggctgatcgcccaagacgaaatccgtagccaagagtatcaggaagtcaaaaccattatcgataagtaccacaaggcattcatcgacgaggcgttgcagaacgttgtactttctaatttggaagaatacgaggctctgttttttgagcgtaaccgcgacgaaaaggcgttcgagaagctgcaagcagtgttgcgtaaagaaattgtagcgcactttaaacaacacccccaatacaagactttgtttaaaaaagagcttattaaggccgatttaaaaaactggcaagagctgtccgacgctgagaaggaattggtgagtcatttcgacaactttacaacatatttcacgggattccacgaaaatcgcgcaaatatgtacacggatgaagctaagcatagcagcatcgcatatcgtatcattcacgaaaacttaccgatctttcttacgaacaaaaaacttttcgagacgattaagcaaaaggccccccaccttgcccaggagacacaggatgcgcttcttgagtatttgtcaggtgcaattgtcgaagacatgttcgaactgtcatattttaaccacttgttatcccaaactcatatcgacctttataatcagatgattggtggcgttaaacaagacagcttgaagatccaaggactgaatgaaaaaatcaatctttaccgccaggctaacggcttatcaaagcgcgaattgccaaacttgaaacccctgcacaaacagattctgagtgaccgtgagacactgtcttggttaccagagagcttcgagtcagacgaagagttaatgcagggtgtgcaggcctacttcgaatcagaggtcttagcctttgagtgttgtgatggtaaagtgaatctgctggaaaaattgccggaactgcttcaccagacccaagattacgactttagcaaagtctattttaaaaacgaccttgctttgacggcagcctcccaggcgatttttaaagattatcgtatcattaaggaggcgttatgggaggtgaataagcctaaaaaatccaaggatctggttgcagatgaggagaaattttttaataagaagaatagttatttcagtatcgagcagattgacggagcactgaatagtgctcaattgtccgccaatatgatgcactattttcaatcagagtcaaccaaggttattgaacagatccagttgacttataacgactggaagcgtaactcatcgaacaaagaacttttaaaagcattcttagacgcgcttttgtcttaccaacgtctgcttaaacctctgaatgcgcctaacgatttagaaaaagatgttgcattttatgcttacttcgatgcgtacttcacgtctttgtgtggagttgtaaaactttacgataaagtacgcaattttatgaccaagaaaccatatagcttggaaaaatttaagttaaactttgagaactccactcttttggacggatgggatgtaaacaaggaatcggataataccgcgattctttttcgtaaggaaggactttattatctgggcatcatgaataagaagtacaataaggtattccgtaatatctcttcttcacaagatgaaggttaccagaagattgattacaaattactgccaggtgccaataaaatgttgccgaaagtttttttttcggataaaaacaaggagtatttcaaaccgaacgcgaagttattagagcgctacaaagctggcgagcataaaaaaggggacaactttgatttagacttctgccatgagttaatcgacttcttcaagacatcaattgaaaaacaccaagactggaagcattttgcctatcagttctcgccaaccgagagttatgaggatctgtcagggttctatcgcgaggttgaacagcaagggtataagatctcttacaaaaatatcgcagcctcttttatcgatactcttgtcgcggaaggaaagctgtatttcttccagatttataataaggatttttcaccgtactctaagggtacacctaatatgcacacattgtactggcgcgctctgttcgatgagaaaaaccttgccgacgtaatctacaaattgaatgggcaagcagagatcttcttccgcaaaaagtcgattgaatattcgcaagaaaaattacaaaaaggtcatcatcacgagatgctgaaggataagtttgcatacccgatcattaaagatcgtcgctttgctttcgataaattccagttccacgtgccaatcacattgaatttcaaggctgagggaaatgagaatattacacctaaaacctttgagtatatccgttctaatcctgataacatcaaagtgatcggaattgaccgtggggaacgccatcttctgtacttatcattgattgatgcggagggcaagattgtggagcaatttaccttgaaccagattattaactcatacaacggaaaggatcatgtaatcgattaccatgcgaaattagatgcgaaggagaaggatcgcgacaaagcccgcaaagagtggggtacagttgaaaacattaaagagttgaaggagggttatctgagccatgtcatccataagatcgctactttgattattgagcatggagcggttgtggcaatggaagatttgaacttcggcttcaagcgtgggcgtttcaaggttgagaaacaagtttatcagaaatttgaaaaggcgcttattgataagttaaattacttggtagacaagaagaaggaaccccacaagctgggggggttattaaatgctttgcaacttacaagtaaattccagagcttcgagaaaatgggaaaacagaacgggtttttgttctatgtgcctgcctggaacacgtcaaagatcgaccctgtgaccgggttcgtaaaccttttcgacactcgttatgcaagcgttgagaagagtaaggccttttttacgaaatttcagtcgatctgttacaacgaagcgaaggactactttgaactggtctttgactataatgactttactgaaaaggccaaggaaacccgctcagaatggacgttatgtacatacggcgagcgtattgtgagctttcgtaacgcggagaagaaccatcaatgggacagcaagaccattcatcttacaacggaatttaagaatctgtttggagagttacacggcaacgatgtgaaggagtatatccttgagcagaactcggtggaattctttaagtcccttatctatttgcttaaaatcactctgcagatgcgtaattctattacaggaactgatattgattacttagtgtcgccggtagctgatgaagccgggaatttctatgacagccgtaaagcggacaccagcttgcccaaggatgcggacgccaatggcgcgtataatattgcacgcaaaggactgatgttaatgcaccgcattcagaacgcagaggacctgaagaaggtaaatcttgcgatctccaatcgcgactggttacgtaacgcccagggccttgataag

SEQ ID NO: 331 - protein, 6 aa, Tobacco etch virus
ENLYFQ

SEQ ID NO: 332 - protein, 7 aa, Artificial Sequence
  Description of Artificial Sequence: Synthetic peptide
GHHHHHH

SEQ ID NO: 333 - protein, 9 aa, Artificial Sequence
  Description of Artificial Sequence: Synthetic peptide
GHHHHHHHH

SEQ ID NO: 334 - protein, 6 aa, Artificial Sequence
  Description of Artificial Sequence: Synthetic 6xHis tag
HHHHHH

SEQ ID NO: 335 - protein, 8 aa, Artificial Sequence
  Description of Artificial Sequence: Synthetic 8xHis tag
HHHHHHHH

What is claimed is:

1. A composition comprising (i) an engineered nucleic acid-guided nuclease comprising an engineered nuclease polypeptide comprising an amino acid sequence having at least 90% sequence identity to any one of SEQ ID NO: 144, 153, and 229, or a polynucleotide encoding an amino acid sequence having at least 90% sequence identity to any one of SEQ ID NO: 144, 153, and 229; and (ii) a compatible guide nucleic acid, wherein the guide nucleic acid is capable of forming a functional complex with the nucleic acid-guided nuclease, thereby directing the nuclease to a target sequence in a human cell.

2. The composition of claim 1 wherein the sequence identity is at least 95%.

3. The composition of claim 1 wherein the sequence identity is 100%.

4. The composition of claim 1 wherein the guide nucleic acid is a split guide nucleic acid.

5. The composition of claim 1 wherein the guide nucleic acid comprises any one of SEQ ID NO: 291-325, or a portion thereof.

6. The composition of claim 1, wherein the nucleic acid-guided nuclease complex comprises an amino acid sequence having at least 90% sequence identity to SEQ ID NO: 144.

7. The composition of claim 1, wherein the nucleic acid-guided nuclease complex comprises an amino acid sequence having at least 90% sequence identity to SEQ ID NO: 153.

8. The composition of claim 1, wherein the guide nucleic acid comprises one or more chemical modifications.

9. A method of creating a strand break at or near a target sequence in a target polynucleotide comprising contacting the target polynucleotide with a targetable nucleic acid-guided nuclease complex, said complex comprising:

(i) an engineered nucleic acid-guided nuclease comprising an engineered nuclease polypeptide comprising an amino acid sequence having at least 90% sequence identity to any one of SEQ ID NO: 144, 153, and 229; and (ii) a compatible guide nucleic acid, wherein the nucleic acid-guided nuclease is complexed with the guide nucleic acid to form a nucleic acid-guided nuclease complex, wherein the compatible guide nucleic acid of the complex targets the target sequence, and allowing the targetable nucleic acid-guided nuclease complex to create the strand break.

10. The method of claim 9 wherein the nucleic acid-guided nuclease complex comprises an engineered nuclease polypeptide comprising an amino acid sequence having at least 90% sequence identity to any one of SEQ ID NO: 144 and 153.

11. The method of claim 9 wherein the nucleic acid-guided nuclease complex comprises an amino acid sequence having at least 90% sequence identity to SEQ ID NO: 153.

12. The method of claim 9 wherein the sequence identity is at least 95%.

13. The method of claim 9 wherein the sequence identity is 100%.

14. The method of claim 9 wherein the guide nucleic acid is a split guide nucleic acid.

15. The method of claim 9 wherein the guide nucleic acid comprises any one of SEQ ID NO: 291-325, or a portion thereof.

16. The method of claim 9 wherein the target polynucleotide is in a cellular genome.

17. The method of claim 16 wherein the editing template comprises a transgene.

18. The method of claim 9 further comprising providing an editing template to be inserted in the target sequence.

19. The method of claim 9 wherein the target polynucleotide is a safe harbor site.

20. A method of modifying expression of a target polynucleotide comprising contacting the target polynucleotide with a targetable nucleic acid-guided nuclease complex, said complex comprising:

(i) an engineered nucleic acid-guided nuclease comprising an engineered nuclease polypeptide comprising an amino acid sequence having at least 90% sequence identity to any one of SEQ ID NO: 144, 153, and 229; and (ii) a compatible guide nucleic acid, wherein the nucleic acid-guided nuclease is complexed with the guide nucleic acid to form a nucleic acid-guided nuclease complex, wherein the compatible guide nucleic acid of the complex targets the target sequence, and allowing the targetable nucleic acid-guided nuclease complex to bind to a target sequence within the target polynucleotide such that the binding can lead to increased or decreased expression of the target polynucleotide.

*    *    *    *    *